(12) United States Patent
Kermani et al.

(10) Patent No.: US 8,407,554 B2
(45) Date of Patent: Mar. 26, 2013

(54) METHOD AND APPARATUS FOR QUANTIFICATION OF DNA SEQUENCING QUALITY AND CONSTRUCTION OF A CHARACTERIZABLE MODEL SYSTEM USING REED-SOLOMON CODES

(75) Inventors: Bahram Ghaffarzadeh Kermani, Los Altos, CA (US); Karen W. Shannon, Encinitas, CA (US)

(73) Assignee: Complete Genomics, Inc., Mountain View, CA (US)

( * ) Notice: Subject to any disclaimer, the term of this patent is extended or adjusted under 35 U.S.C. 154(b) by 489 days.

(21) Appl. No.: 12/697,995

(22) Filed: Feb. 1, 2010

(65) Prior Publication Data

US 2010/0199155 A1 Aug. 5, 2010

Related U.S. Application Data

(60) Provisional application No. 61/149,617, filed on Feb. 3, 2009.

(51) Int. Cl.
*H03M 13/03* (2006.01)
*H03M 13/15* (2006.01)
(52) U.S. Cl. ........................... 714/752; 714/784
(58) Field of Classification Search .......... 714/755, 714/784, 752
See application file for complete search history.

(56) References Cited

U.S. PATENT DOCUMENTS

| 4,584,686 | A | 4/1986 | Fritze |
| 6,430,723 | B2 | 8/2002 | Kodama et al. |
| 7,228,485 | B1 | 6/2007 | Wu et al. |
| 2005/0089860 | A1* | 4/2005 | Arita ............................. 435/6 |
| 2007/0042372 | A1* | 2/2007 | Arita ............................. 435/6 |
| 2007/0113137 | A1 | 5/2007 | Ryu |
| 2008/0320358 | A1 | 12/2008 | Pandel et al. |
| 2009/0172501 | A1 | 7/2009 | Lablans |
| 2010/0192032 | A1* | 7/2010 | Chen et al. ................. 714/746 |

OTHER PUBLICATIONS

International Search Report and Written Opinion corresponding to the PCT application No. PCT/US2010/023083, date of mailing Mar. 30, 2010, 8 pages total.
Drmanac et al., "Human Genome Sequencing Using Unchained Base Reads on Self-Assembling DNA Nanoarrays", pp. 78-81, Science, Jan. 1, 2010, vol. 327. No. 5961, Originally published in Science Express on Nov. 5, 2009.
Sklar, B., "Reed-Solomon Codes," Apr. 12, 2002, 33 pages, retrieved from the internet <URL: hscc.cs.nthu.edu.tw/~sheujp/lecture_note/rs.pdf>.
Hamady, M, et al., "Error-correcting barcoded primers allow hundreds of samples to be pyrosequenced in multiplex," NIH Public Access Author Manuscript, 6 pages, published in final edited form as: Nat Methods, Mar. 2008, vol. 5(3), pp. 235-237.
Sylvester, J., "Reed Solomon Codes," Jan. 2001, 7 pages, retrieved from the internet <URL:www.csupomona.edu/~jskang/files/rs1.pdf>.

(Continued)

*Primary Examiner* — Stephen M Baker
(74) *Attorney, Agent, or Firm* — Kilpatrick Townsend & Stockton LLP

(57) ABSTRACT

Data extracted from fluorosphore responses of fluorophore labeled bases in genetic material used in sequencing of unknown fragments from a defined set of for example a model system are converted into a class of block codes that are then employed in a computer-based process to compare and correct preliminary calls of calls of the categorically known genetic material. In a specific embodiment, the Reed-Solomon codes are employed to identify one or more errors as may occur in a finite block of codes. The methodology is also useful to identify elements of a real system containing known elements in the form of a tag. Reed-Solomon sensors may be employed with and in addition to other types of genome sensors.

62 Claims, 3 Drawing Sheets

OTHER PUBLICATIONS

Bonaldo, M. F., et al., "Normalization and subtraction: two approaches to facilitate gene discovery," Genome Research, 1996, vol. 6, pp. 791-806.

Frank, D. N., "Barcrawl and Bartab: software tools for the design and implementation of barcoded primers for highly multiplexed DNA sequencing," BMC Bioinformatics 2009, [online], Oct. 29, 2009, 13 pages, retrieved from the internet <URL: http://www.biomedcentral.com/1471-2105/10/362>.

Meyer, M., et al., "Targeted high-throughput sequencing of tagged nucleic acid samples," Nucleic Acids Research, 2007, vol. 35, No. 15, 5 pages.

Parameswaran, P., et al., "A pyrosequencing-tailored nucleotide barcode design unveils opportunities for large-scale sample multiplexing," Nucleic Acids Research, 2007, vol. 35, No. 19, 9 pages.

* cited by examiner

| Index | Observed Sequence | Corrected Sequence | Solomon Recovered | Score 1 | Score 2 | Score 3 | Score 4 | Score 5 | Score 6 | Score 7 |
|---|---|---|---|---|---|---|---|---|---|---|
| 2560 | TACGTAG | TACGTAG | 0 | 0.84 | 0.82 | 0.81 | 0.32 | 0.81 | 0.84 | 0.09 |
| 2561 | TGGCTAA | TGGCAAA | 1 | 0.06 | 0.01 | 0.01 | 0 | 0.01 | 0.1 | 0.05 |
| 2562 | TGGCAAA | TGGCAAA | 0 | 0.94 | 0.86 | 0.87 | 0.87 | 0.85 | 0.9 | 0.95 |
| 2563 | AGGAAAA | AGGAAAG | 1 | 0 | 0.05 | 0.04 | 0 | 0 | 0.01 | 0 |
| 2564 | AGGAAAG | AGGAAAG | 0 | 0.13 | 0.21 | 0.28 | 0.12 | 0.21 | 0.05 | 0.12 |

| Categories | Observed Sequences | Reed-Solomon Corrected Sequences |
|---|---|---|
| Number of Valid Sequences | 20647 | 35317 |
| Number of UnCalled Sequences | 0 | 15308 |
| Number of Invalid Sequences | 29978 | 0 |
| Total | 50625 | 50625 |

| Index | Observed Sequence | Corrected Sequence | Reed-Solomon Recovered | Score 1 | Score 2 | Score 3 | Score 4 | Score 5 | Score 6 | Score 7 | Score 8 | Score 9 | Score 10 |
|---|---|---|---|---|---|---|---|---|---|---|---|---|---|
| 20 | CGGTTCTTAT | CGGTACTTAT | 1 | 0.1574 | 0.4825 | 0.2193 | 0.4314 | 0.0104 | 0.2906 | 0.2856 | 0.0262 | 0.0254 | 0.1353 |
| 29 | GTAAGACTGC | GTAAGACTGC | 0 | 0.9143 | 0.8828 | 0.9396 | 0.9122 | 0.8947 | 0.9499 | 0.959 | 0.9488 | 0.9444 | 0.9335 |
| 30 | AGACTGGCGC | AGACTGGAGC | 1 | 0.0968 | 0.0579 | 0.114 | 0.0141 | 0.0735 | 0.2902 | 0.3316 | 0.0029 | 0.4844 | 0.5554 |
| 37 | AGGACACCGC | AGGATACCGC | 1 | 0.9943 | 0.0615 | 0.5716 | 0.6492 | 0.0587 | 0.1396 | 0.1302 | 0.1057 | 0.1038 | 0.9983 |
| 40 | CGCGAGTCGA | CGCGAGTCGA | 0 | 0.1824 | 0.886 | 0.9227 | 0.911 | 0.9232 | 0.9505 | 0.9399 | 0.97 | 0.9421 | 0.9668 |
| 50 | AAAAGTCCGG | AAAAGTCCGG | 0 | 0.8932 | 0.8876 | 0.8989 | 0.8734 | 0.8854 | 0.2525 | 0.6954 | 0.8807 | 0.9075 | 0.9415 |
| 68 | ACTTTATTAC | ********** | 0 | 0 | 0.0007 | 0.0406 | 0 | 0 | 0 | 0 | 0 | 0 | 0 |
| 69 | ACTAACCGTA | ACTAACCGTA | 0 | 0.8452 | 0.8646 | 0.8521 | 0.8821 | 0.6185 | 0.8762 | 0.882 | 0.8881 | 0.8917 | 0.882 |
| 70 | CACATGTTAC | CACATGTTAC | 0 | 0.9579 | 0.9647 | 0.981 | 0.974 | 0.9926 | 0.9801 | 0.9575 | 0.9429 | 0.9281 | 0.9401 |
| 71 | TTGCGGGCTT | TTGCGGGCCT | 1 | 0.4263 | 0.6358 | 0.3367 | 0.1561 | 0.4507 | 0.2606 | 0.2678 | 0.2049 | 0.0075 | 0.5003 |
| 73 | TACTCAGTCA | CACTCAGTCA | 1 | 0 | 0.3616 | 0.3828 | 0.6239 | 0.174 | 0.2373 | 0.0189 | 0.3441 | 0.0502 | 0.0959 |
| 74 | CTAGAGTTTC | CTAGAGTTTC | 0 | 0.3268 | 0.9163 | 0.9362 | 0.9205 | 0.9314 | 0.9724 | 0.9342 | 0.9254 | 0.9255 | 0.9675 |
| 85 | ACACCACCGC | ACACCACCGC | 0 | 0.7051 | 0.9319 | 0.903 | 0.9003 | 0.8817 | 0.9548 | 0.9731 | 0.9805 | 0.9563 | 0.9484 |
| 109 | ACACAACGCC | ACACGACGCC | 1 | 0.7707 | 0.0847 | 0.8321 | 0.0349 | 0.0093 | 0.9404 | 0.9251 | 0.9244 | 0.9463 | 0.9096 |

*FIG. 4*

METHOD AND APPARATUS FOR QUANTIFICATION OF DNA SEQUENCING QUALITY AND CONSTRUCTION OF A CHARACTERIZABLE MODEL SYSTEM USING REED-SOLOMON CODES

CROSS-REFERENCES TO RELATED APPLICATIONS

The present application claims benefit under 35 USC 119 (e) of U.S. provisional Application No. 61/149,617, filed on Feb. 3, 2009, entitled "Method And Apparatus For Correcting DNA Sequencing Errors Using Reed-Solomon Codes," the content of which is incorporated herein by reference in its entirety.

STATEMENT AS TO RIGHTS TO INVENTIONS MADE UNDER FEDERALLY SPONSORED RESEARCH OR DEVELOPMENT

NOT APPLICABLE

REFERENCE TO A "SEQUENCE LISTING," A TABLE, OR A COMPUTER PROGRAM LISTING APPENDIX SUBMITTED ON A COMPACT DISK

Not applicable.

BACKGROUND OF THE INVENTION

The invention relates to techniques for characterizing the accuracy of genome sequence analysis, and more particularly to the use of advanced mathematical methods for correction of observational errors in sequences having portions of known content.

Large-scale genomic sequence analysis ("sequencing") is a key step toward understanding a wide range of biological phenomena. The need for low-cost, high-throughput sequencing and re-sequencing has led to the development of new approaches to sequencing that employ parallel analysis of multiple nucleic acid targets simultaneously.

Conventional methods of sequencing are generally restricted to determining a few tens of nucleotides before signals become significantly degraded, thus placing a significant limit on overall sequencing efficiency. Conventional methods of sequencing are also often limited by signal-to-noise ratios that render such methods unsuitable for single-molecule sequencing.

A challenge of genome sequencing is the accurate recognition, identification, characterization and classification of DNA strands. Efforts have been developed for improving DNA sensing, analysis and measurement throughput by manipulation of DNA including the manipulation of DNA nanoballs ("DNB"). The techniques for sequencing DNB involve the categorization of fluorophore responses of DNB at genome attachment sites on rigid substrates in the presence of interference from adjacent attachment sites. A specific categorization is known as a call, as hereinafter explained. Signal-to-noise ratios in DNA sequencing can be relatively low, which adversely impacts base quality score.

Improvements in base quality score would allow better characterization of the sequencing system and its failure modes. Improvements would also allow one to quantify improvements in such aspects as the substrate, the biochemistry, the methodology of preparation of samples, the mechanical systems and optical systems, and the mathematical algorithms that analyze and yield the calls.

Linear block cyclic symbol-based error correction methods relying on error correcting codes have been used to identify and correct bit streams in impaired communication channels, subject to limitations on error rate and run length. Types of codes used in the past for error correction of bit errors in DNA are the Hamming codes. These codes are capable of correcting for one bit error but not one base error. However, Hamming codes are not capable of correcting a large number of errors in a sequence.

Reed-Solomon error detection/correction is a method based on an error-correcting code that works by oversampling a polynomial constructed from the data. Sampling the polynomial more often than is necessary makes the polynomial over-determined. As long as more than a minimum number of the samples are correct, the original polynomial can be recovered in the presence of a some bad points. The relationship between to good and bad points determines the number of errors that can be corrected.

Reed-Solomon codes have been explained at length in the mathematics and communication literature. See for example *Error Control Coding: Fundamentals and Applications* by Shu Lin and Daniel Costello; Prentice Hall; and *Error Control Systems for Digital Communication and Storage*, by Stephen B. Wicker; Prentice Hall. It has been shown that if it is guaranteed that there are less than one error in a string of seven values in a sequence having four possible values, then the related mathematics can guarantee that an error in the seven-member long sequence can be captured and corrected.

It would be advantageous for the field of genome analysis if methods could be designed to characterize and potentially increase the accuracy and call-rate/efficiency of sequencing.

In the following description, numerous specific details are set forth to provide a more thorough understanding of the present invention. However, it will be apparent to one of skill in the art that the present invention may be practiced without one or more of these specific details. In other instances, well-known features and procedures well known to those skilled in the art have not been described in order to avoid obscuring the invention.

The practice of genome analysis may employ, unless otherwise indicated, conventional techniques and descriptions of organic chemistry, polymer technology, molecular biology (including recombinant techniques), cell biology, biochemistry, and immunology, which are within the skill of the art. Such conventional techniques include polymer array synthesis, hybridization, ligation, and detection of hybridization using a label. The present invention focuses on the detection problem. Conventional techniques and descriptions can be found in standard laboratory manuals such as *Genome Analysis: A Laboratory Manual Series* (Vols. I-IV), *Using Antibodies: A Laboratory Manual, Cells: A Laboratory Manual, PCR Primer: A Laboratory Manual*, and *Molecular Cloning: A Laboratory Manual* (all from Cold Spring Harbor Laboratory Press); Stryer, L. (1995) *Biochemistry* (4th Ed.) Freeman, New York, Gait, "*Oligonucleotide Synthesis: A Practical Approach,*" 1984, IRL Press, London, Nelson and Cox (2000); Lehninger, *Principles of Biochemistry* $3^{rd}$ Ed., W. H. Freeman Pub., New York, N.Y. and Berg et al. (2002) *Biochemistry*, $5^{th}$ Ed., W. H. Freeman Pub., New York, N.Y., all of which are herein incorporated in their entirety by reference for all purposes.

As used herein and in the appended claims, the singular forms "a," "an," and "the" include plural referents unless the context clearly dictates otherwise. Thus, for example, reference to "a polymerase" refers to one agent or mixtures of such agents, and reference to "the method" includes reference to equivalent steps and methods known to those skilled in the art, and so forth.

Unless defined otherwise, all technical and scientific terms used herein have the same meaning as commonly understood by one of ordinary skill in the art to which this invention belongs. All publications mentioned herein are incorporated herein by reference for the purpose of describing and disclosing devices, compositions, formulations and methodologies which are described in the publication and which might be used in connection with the presently described invention.

Where a range of values is provided, it is understood that each intervening value, to the tenth of the unit of the lower limit unless the context clearly dictates otherwise, between the upper and lower limit of that range and any other stated or intervening value in that stated range is encompassed within the invention. The upper and lower limits of these smaller ranges may independently be included in the smaller ranges is also encompassed within the invention, subject to any specifically excluded limit in the stated range. Where the stated range includes one or both of the limits, ranges excluding either both of those included limits are also included in the invention.

The following definitions may be helpful in providing background for an understanding of the invention.

"Adaptor" refers to an engineered construct comprising "adaptor elements" where one or more adaptors may be interspersed within target nucleic acid in a library construct. The adaptor elements or features included in any adaptor vary widely depending on the use of the adaptors, but typically include sites for restriction endonuclease recognition and/or cutting, sites for primer binding (for amplifying the library constructs) or anchor primer binding (for sequencing the target nucleic acids in the library constructs), nickase sites, and the like. In some aspects, adaptors are engineered so as to comprise one or more of the following: 1) a length of about 20 to about 250 nucleotides, or about 40 to about 100 oligonucleotides, or less than about 60 nucleotides, or less than about 50 nucleotides; 2) features so as to be ligated to the target nucleic acid as at least one and typically two "arms"; 3) different and distinct anchor binding sites at the 5' and/or the 3' ends of the adaptor for use in sequencing of adjacent target nucleic acid; and 4) optionally one or more restriction sites "Amplicon" means the product of a polynucleotide amplification reaction. That is, it is a population of polynucleotides that are replicated from one or more starting sequences. Amplicons may be produced by a variety of amplification reactions, including but not limited to polymerase chain reactions (PCRs), linear polymerase reactions, nucleic acid sequence-based amplification, circle dependant amplification and like reactions (see, e.g., U.S. Pat. Nos. 4,683,195; 4,965,188; 4,683,202; 4,800159; 5,210,015; 6,174,670; 5,399,491; 6,287,824 and 5,854,033; and US Pub. No. 2006/0024711).

"Circle dependant replication" or "CDR" refers to multiple displacement amplification of a double-stranded circular template using one or more primers annealing to the same strand of the circular template to generate products representing only one strand of the template. In CDR, no additional primer binding sites are generated and the amount of product increases only linearly with time. The primer(s) used may be of a random sequence (e.g., one or more random hexamers) or may have a specific sequence to select for amplification of a desired product. Without further modification of the end product, CDR often results in the creation of a linear construct having multiple copies of a strand of the circular template in tandem, i.e. a linear, concatamer of multiple copies of a strand of the template.

"Circle dependant amplification" or "CDA" refers to multiple displacement amplification of a double-stranded circular template using primers annealing to both strands of the circular template to generate products representing both strands of the template, resulting in a cascade of multiple-hybridization, primer-extension and strand-displacement events. This leads to an exponential increase in the number of primer binding sites, with a consequent exponential increase in the amount of product generated over time. The primers used may be of a random sequence (e.g., random hexamers) or may have a specific sequence to select for amplification of a desired product. CDA results in a set of concatameric double-stranded fragments.

"Complementary" or "substantially complementary" refers to the hybridization or base pairing or the formation of a duplex between nucleotides or nucleic acids, such as, for instance, between the two strands of a double-stranded DNA molecule or between an oligonucleotide primer and a primer binding site on a single-stranded nucleic acid. Complementary nucleotides are, generally, A and T (or A and U), or C and G. (Univeral bases may be used in some appropriate in some applications.) Two single-stranded RNA or DNA molecules are said to be substantially complementary when the nucleotides of one strand, optimally aligned and compared and with appropriate nucleotide insertions or deletions, pair with at least about 80% of the other strand, usually at least about 90% to about 95%, and even about 98% to about 100%.

"Duplex" means at least two oligonucleotides or polynucleotides that are fully or partially complementary and which undergo Watson-Crick type base pairing among all or most of their nucleotides so that a stable complex is formed. The terms "annealing" and "hybridization" are used interchangeably to mean formation of a stable duplex. "Perfectly matched" in reference to a duplex means that the poly- or oligonucleotide strands making up the duplex form a double-stranded structure with one another such that every nucleotide in each strand undergoes Watson-Crick base pairing with a nucleotide in the other strand. A "mismatch" in a duplex between two oligonucleotides or polynucleotides means that a pair of nucleotides in the duplex fails to undergo Watson-Crick base pairing.

"Hybridization" refers to the process in which two single-stranded polynucleotides bind non-covalently to form a stable double-stranded polynucleotide. The resulting (usually) double-stranded polynucleotide is a "hybrid" or "duplex." "Hybridization conditions" will typically include salt concentrations of less than about 1M, more usually less than about 500 mM and may be less than about 200 mM. A "hybridization buffer" is a buffered salt solution such as 5% SSPE, or other such buffers known in the art. Hybridization temperatures can be as low as 5° C., but are typically greater than 22° C., and more typically greater than about 30° C., and typically in excess of 37° C. Hybridizations are usually performed under stringent conditions, i.e., conditions under which a probe will hybridize to its target subsequence but will not hybridize to the other, uncomplimentary sequences. Stringent conditions are sequence-dependent and are different in different circumstances. For example, longer fragments may require higher hybridization temperatures for specific hybridization than short fragments. As other factors may affect the stringency of hybridization, including base composition and length of the complementary strands, presence of organic solvents, and the extent of base mismatching, the combination of parameters is more important than the absolute measure of any one parameter alone. Generally stringent conditions are selected to be about 5° C. lower than the Tm for the specific sequence at a defined ionic strength and pH. Exemplary stringent conditions include a salt concentration of at least 0.01M to no more than 1M sodium ion concentration (or other salt) at a pH of about 7.0 to about 8.3 and a temperature of at least 25° C. For example, conditions of 5× SSPE (750 mM NaCl, 50 mM sodium phosphate, 5 mM EDTA at pH 7.4) and a temperature of 30° C. are suitable for allele-specific probe hybridizations.

"Isolated" means substantially separated or purified away from contaminants by standard methods. In the case of biological heteropolymers such as polynucleotides (DNA, RNA, etc.) for example, the polynucleotide is substantially separated or purified away from other polynucleotides and other contaminants that are present in the cell of the organism in which the polynucleotide naturally occurs. The term "isolated" also means chemically synthesized or, in the case of a polynucleotide or polypeptide, produced by recombinant expression in a host cell.

"Ligation" means to form a covalent bond or linkage between the termini of two or more nucleic acids, e.g., oligonucleotides and/or polynucleotides, in a template-driven reaction. The nature of the bond or linkage may vary widely and the ligation may be carried out enzymatically or chemically. As used herein, ligations are usually carried out enzymatically to form a phosphodiester linkage between a 5' carbon terminal nucleotide of one oligonucleotide with a 3' carbon of another nucleotide. Template driven ligation reactions are described in the following references: U.S. Pat. Nos. 4,883,750; 5,476,930; 5,593,826; and 5,871,921.

"Microarray" or "array" refers to a solid phase support having a surface, preferably but not exclusively a planar or substantially planar surface, which carries an array of sites containing nucleic acids such that each site of the array comprises identical copies of oligonucleotides or polynucleotides and is spatially defined and not substantially overlapping with other member sites of the array; that is, the sites are spatially discrete. The array or microarray can also comprise a non-planar structure with a surface such as a bead or a well. The oligonucleotides or polynucleotides of the array may be covalently bound to the solid support, or may be non-covalently bound. Conventional microarray technology is reviewed in, e.g., Schena, Ed. (2000), Microarrays: A Practical Approach (IRL Press, Oxford). As used herein, "random array" or "random microarray" refers to a microarray where the identity of the oligonucleotides or polynucleotides is not discernable, at least initially, from their location but may be determined by a particular operation on the array, such as by sequencing, hybridizing decoding probes or the like. See, e.g., U.S. Pat. Nos. 6,396,995; 6,544,732; 6,401,267; and 7,070,927; WO publications WO 2006/073504 and 2005/082098; and US Pub Nos. 2007/0207482 and 2007/0087362.

"Nucleic acid", "oligonucleotide", "polynucleotide", "oligo" or grammatical equivalents used herein refers generally to at least two nucleotides covalently linked together. A nucleic acid generally will contain phosphodiester bonds, although in some cases nucleic acid analogs may be included that have alternative backbones such as phosphoramidite, phosphorodithioate, or methylphophoroamidite linkages; or peptide nucleic acid backbones and linkages. Other analog nucleic acids include those with bicyclic structures including locked nucleic acids, positive backbones, non-ionic backbones and non-ribose backbones. Modifications of the ribose-phosphate backbone may be done to increase the stability of the molecules; for example, PNA:DNA hybrids can exhibit higher stability in some environments.

"Preselected," when used in reference to a block of a monomer subunit sequence that has a coding corresponding to at least one Reed-Solomon code, means that the heteropolymer is designed and/or synthesized to include the block of monomer sequence or that the block of monomer sequence is added to a preexisting heteropolymer sequence. For example, by way of illustration, a polynucleotide can be designed to include a block of five to ten nucleotide bases, such as the seven or ten nucleotide base sequences described herein, or a polynucleotide containing such a five to ten base block can be added to a preexisting polynucleotide by ligation or other standard methods.

"Primer" means an oligonucleotide, either natural or synthetic, which is capable, upon forming a duplex with a polynucleotide template, of acting as a point of initiation of nucleic acid synthesis and being extended from its 3' end along the template so that an extended duplex is formed. The sequence of nucleotides added during the extension process is determined by the sequence of the template polynucleotide. Primers usually are extended by a DNA polymerase.

"Probe" means generally an oligonucleotide that is complementary to an oligonucleotide or target nucleic acid under investigation. Probes used in certain aspects of the claimed invention are labeled in a way that permits detection, e.g., with a fluorescent or other optically-discernable tag.

"Sequence determination" in reference to a target nucleic acid means determination of information relating to the sequence of nucleotides in the target nucleic acid. Such information may include the identification or determination of partial as well as full sequence information of the target nucleic acid. The sequence information may be determined with varying degrees of statistical reliability or confidence. In one aspect, the term includes the determination of the identity and ordering of a plurality of contiguous nucleotides in a target nucleic acid starting from different nucleotides in the target nucleic acid.

"Substrate" refers to a solid phase support having a surface, usually planar or substantially planar, which carries an array of sites for attachment of nucleic acid macromolecules such that each site of the array is spatially defined and not overlapping with other member sites of the array; that is, the sites are spatially discrete and optically resolvable. The nucleic acid macromolecules of the substrates of the invention may be covalently bound to the solid support, or may be non-covalently bound, i.e. through electrostatic forces. Conventional microarray technology is reviewed in, e.g., Schena, Ed. (2000), Microarrays: A Practical Approach (IRL Press, Oxford).

"Macromolecule" used in relation to a nucleic acid means a nucleic acid having a measurable three dimensional structure, including linear nucleic acid molecules with comprising secondary structures (e.g., amplicons), branched nucleic acid molecules, and multiple separate copies of individual with interacting structural elements, e.g., complementary sequences, palindromes, or other sequence inserts that cause three-dimensional structural elements in the nucleic acid.

"Target nucleic acid" means a nucleic acid from a gene, a regulatory element, genomic DNA, cDNA, RNAs including mRNAs, rRNAs, siRNAs, miRNAs and the like and fragments thereof. A target nucleic acid may be a nucleic acid from a sample, or a secondary nucleic acid such as a product of an amplification reaction.

Although the present invention is described primarily with reference to specific embodiments, it is also envisioned that other embodiments will become apparent to those skilled in the art upon reading the present disclosure, and it is intended that such embodiments be contained within the present inventive methods.

SUMMARY OF THE INVENTION

According to the invention, data extracted from labeled bases in genetic material, such as fluorosphore responses of fluorophore labeled bases in genetic material, used in sequencing of unknown fragments from a defined set of for example a model system are converted into a class of block codes that are then employed in a computer-based process to compare and correct preliminary calls of the unknown genetic material. In a specific embodiment, the Reed-Solomon codes are employed to identify, detect and preferably correct one or more errors as may occur in a finite block of codes corresponding to a DNA sequence. The methodology is not only useful for verification of known sequences of a model system used to characterize a real system, it is useful to identify elements of a real system containing known elements in the form of a tag. Reed-Solomon sensors may be employed with and in addition to other types of genome sensors. Compositions of materials are disclosed that can serve as models and diagnostic tools.

In a specific embodiment of the invention, using a seven base model system and more specifically an RS(7,5) code using 256 (7-base) sequences, namely having a block size of seven and information content of five, Reed-Solomon error correction can unambiguously correct one short burst of error, i.e., a single base transition error in a sequence, as well as correct two no-calls. (A no-call is: 1) a base that could not be called; or 2) a base that has a quality score less than a preselected confidence threshold.) As a consequence, processing according to the invention can recover 100% of the valid DNB call sequences that incurred 1 error or less in their 7-base sequence while suppressing many invalid or low quality DNB call sequences.

A further specific embodiment and in some applications a preferred embodiment comprises a 10-base model system, namely, an RS(10,8) code using 4096 (10-base) sequences that is capable of greater error correction. It is also to be understood that a 5-base model system may also be usefully employed under selected conditions, namely an RS(5,3) code using 5-base sequences.

Sequence listings for two artificial sequences according to the invention are included in the text and in a separate sequence listing. The invention will be better understood by reference to the following detailed description in connection with the accompanying drawings.

BRIEF DESCRIPTION OF THE DRAWINGS

FIG. 4 is a table illustrating experimental results of a Reed-Solomon correction on a set of 10-mer DNA sequences (SEQ ID NOS:4099, 3909, 3762, 3762, 4100, 697, 4101, 1316, 1928, 1928, 1515, 1515, 4102, 2378, 2378, 4016, 4016, 4103, 1708, 4104, 3608, 3970, 3970, 1316, 1316, 4105 and 2346, respectively).

DETAILED DESCRIPTION OF THE INVENTION

A genome is not random. A genome is a form of an oriented linear heteropolymer that contains overlapping structures and duplicates in monomer subunit sequences, all of which are built out of a limited set of base pairs, typically denominated C, G, A and T. Some genomes are circular. Thus one can say that for those, the circle can be opened and an arbitrary point and thus be treated as a linear genome. These characteristics can be exploited in the process of genome sequencing. Other constructs in this category include amino acids, monomer subunits as a sequence of nucleotides and artificial DNA sequences comprising at least one oligonucleotide. All of these constructs may be processed as hereinafter explained.

Figure 1:
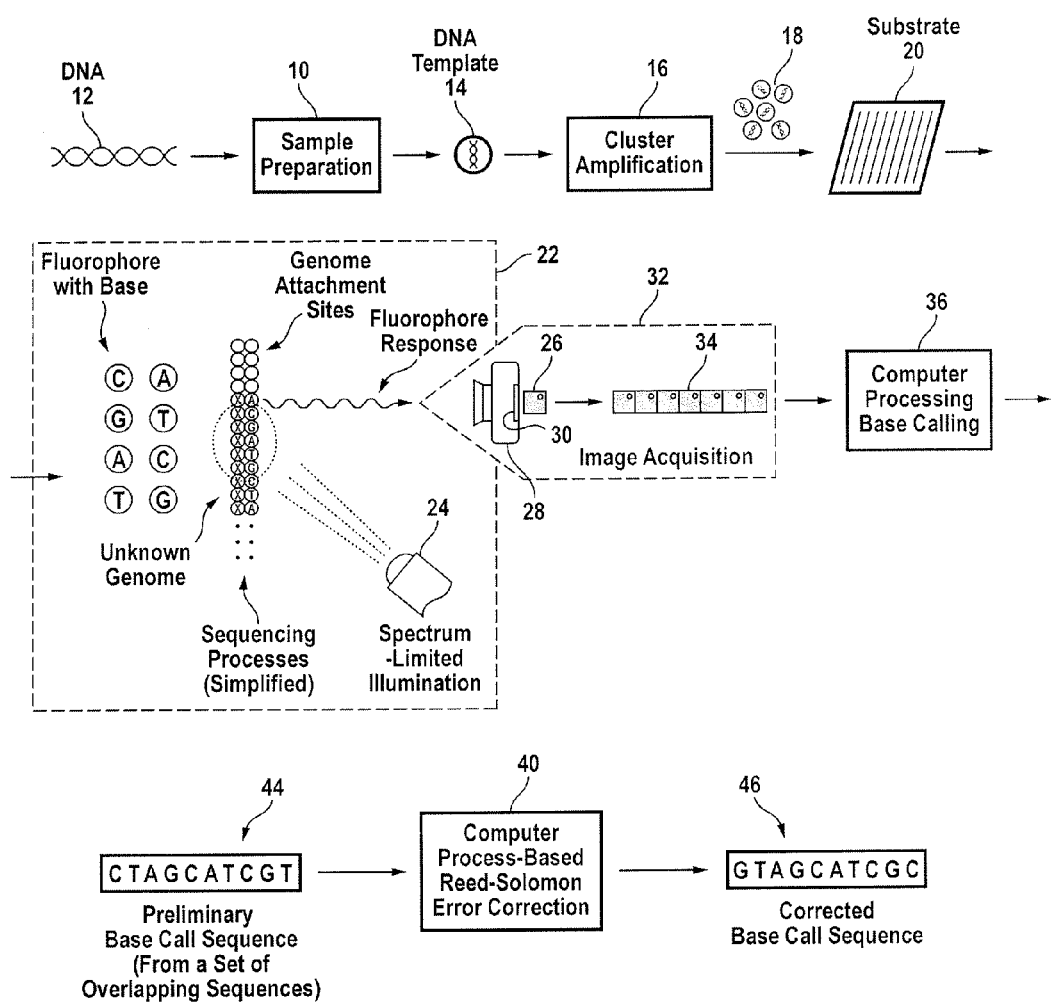
FIG. 1 is a block diagram of an environment that may employ a process according to the invention, which shows preliminary base call sequence=SEQ ID NO:4097 and corrected base call sequence=SEQ ID NO:4098.

Referring to FIG. 1, the overall method for sequencing target nucleic acids, which has been explained in detail elsewhere, includes sample preparation 10 involving extracting and fragmenting target nucleic acids from a DNA sample 12 to produce fragmented target nucleic acid templates 14 that will generally include one or more adaptors. The target nucleic acid templates 14 are optionally subjected to amplification methods 16 to form nucleic acid nanoballs, herein DNBs 18, which are typically disposed on a surface or substrate 20 for purpose of analysis. The substrate may yield patterned or random arrangements of DNBs. Nucleotide sequencing processes 22 are performed on the nucleic acid nanoballs, typically through sequencing-by-ligation techniques, including combinatorial probe anchor ligation ("cPAL") methods, which are described, for example, in Drmanac et al., "Human Genome Sequencing Using Unchained Base Reads on Self-Assembling DNA Nanaoarrays," *Science* 327:78-81, 2009 (Jan. 1, 2010), as well as in published PCT patent applications WO07/133831, WO06/138257, WO06/138284, WO07/044245, WO08/070352, WO08/058282, WO08/070375; and published U.S. patent applications 2007-0037152 and 2008-0221832. In such methods, known labels, such as specific fragments containing a single molecule of a distinguishable fluorophore, are attached as labels according to well-understood rules to the target nucleic acid templates, then resequence indexed on the same types of DNA strand to provide the basis of overlapping data. The sequencing processes 22 referred to herein are merely representative. In another embodiment, tagging is employed. Other processing techniques known or developed in the art may be employed. Then the collection of DNBs on the substrate is irradiated with radiation 24 to excite the fluorophores sufficient to cause the fluorophores associated with each specific label C, G, A or T to fluoresce at their unique wavelengths, from which a spatial image 26 can be made by a camera 28, on a (standard or time-delay integration TDI) CCD array or a scanner in lieu of a CCD array, or other electronic current/voltage sensing techniques. Other sensing mechanisms, such as impedance change sensors, may also be employed. The irradiation may be spectrum specific to excite only a selected fluorophore at a time, which can then be recorded by the camera, or the input to the camera 30 may be filtered to sense and record only spectrum-specific received fluorescent radiation, or all fluorescent radiation can be sensed and recorded simultaneously on a color LCD array and then later analyzed for spectral content at each interrogation site in which there is a nucleic acid construct. The image acquisition 32 yields a series 34 of images of a plurality of interrogation sites that can be analyzed based on spectrum-specific fluorescence intensity through computer processing of the levels of intensity in a process herein denoted as base calling 36 and explained in greater detail herein below. The cPAL and other sequencing methods can also be used to detect specific sequences, such as including Single Nucleotide Polymorphisms ("SNPs") in nucleic acid constructs, (which include nucleic acid nanoballs as well as linear and circular nucleic acid templates). The calls, or identification of the sequences of base calls, e.g., base calls 44 (herein shown not as overlapping), may contain errors for reasons evident by the nature of the sequencing procedure. Using the computer process-based Reed-Solomon error correction 40 of the invention, whether in the form of a computer processor perform a Reed-Solomon algorithm or in the form of a comparison mechanism using precomputed expected base call sequences, such as in a look-up table, errors can be identified, "nocall" sequences can be flagged and corrections can be made to yield corrected base call sequences 46. It should be understood that the magnitude of the sites and structures herein depicted are merely a minute fraction of the magnitude of the sites and structures analyzed on a substrate 20, as they do not easily admit to illustration. For example the substrate may be a photolithographically etched, surface modified (SOM) 25 mm by 75 mm silicon substrate with grid-patterned arrays of about 300-nm spots for DNB binding to increase DNA content per array and improve image information density as compared to random genomic DNA arrays.

Sequencing probes may be detectably labeled with a wide variety of labels. Although the foregoing and following description is primarily directed to embodiments in which the sequencing probes are labeled with fluorophores, it will be appreciated that similar embodiments utilizing sequencing probes comprising other kinds of labels are encompassed by the present invention. Moreover, the processes according to the invention can be employed with unlabeled structures.

Multiple cycles of cPAL (whether single, double, triple, etc.) will identify multiple bases in the regions of the target nucleic acid adjacent to the adaptors. (It is possible to employ a single cycle of cPAL to render multiple bases in an alternate design.) In brief, cPAL methods are repeatedly executed for interrogation of multiple bases within a target nucleic acid by cycling anchor probe hybridization and enzymatic ligation reactions with sequencing probe pools designed to detect nucleotides at varying positions removed from the interface between the adaptor and target nucleic acid. In any given cycle, the sequencing probes used are designed such that the identity of one or more of the bases at one or more positions is correlated with the identity of the label attached to that sequencing probe. Once the ligated sequencing probe (and hence the base or bases at the interrogation position or positions are detected, the ligated complex is stripped off of the DNB and a new cycle of adaptor and sequencing probe hybridization and ligation is conducted. By this mechanism, oversampled data are obtainable. Oversampling is done by sequencing more cycles than needed to decode an N-mer.

Four different fluorophores are typically used to identify a base at an interrogation site within a sequencing probe. Conventionally a single base is queried per hybridization-ligation-detection cycle. However, as will be appreciated, embodiments utilizing 8, 16, 20 and 24 fluorophores or more are also encompassed by the present invention. Increasing the number of fluorophores, or using shades of the same fluorophores, or using a combination of the fluorophores increases the number of bases that can be identified during any one cycle.

In one exemplary embodiment, a set of 7-mer pools of sequencing probes is employed having the following structures, according to conventional notation:

```
3'-F1-NNNNNNAp

3'-F2-NNNNNNGp

3'-F3-NNNNNNCp

3'-F4-NNNNNNTp
```

The "p" represents a phosphate available for ligation and "N" represents degenerate bases. F1-F4 represent four different fluorophores—each fluorophore is thus associated with a particular base, A, G, C or T. This exemplary set of probes would allow detection of the base immediately adjacent to the adaptor upon ligation of the sequencing probe to an anchor probe hybridized to the adaptor. To the extent that the ligase used to ligate the sequencing probe to the anchor probe discriminates for complementarity between the base at the interrogation position of the probe and the base at the detection position of the target nucleic acid, the fluorescent signal that would be detected upon hybridization and ligation of the sequencing probe provides the identity of the base at the detection position of the target nucleic acid. In some embodiments, a set of sequencing probes will comprise three differentially labeled sequencing probes, with a fourth optional sequencing probe left unlabeled.

After performing a hybridization-ligation-detection cycle, the anchor probe-sequencing probe ligation products are stripped and a new cycle is begun. The accuracy of identification of bases and by extension the number of bases that can be consistently and accurately identified can be increased using the error correction methods described herein.

Imaging acquisition may be performed using methods known in the art, including the use of commercial imaging packages such as Metamorph (Molecular Devices, Sunnyvale, Calif.). Data extraction may be performed by a series of binaries written in, e.g., C/C++ and base-calling and read-mapping may be performed by a series of Matlab and Perl scripts.

In an exemplary embodiment, DNBs disposed on a surface undergo a cycle of cPAL in which the sequencing probes utilized are labeled with four different fluorophores (each corresponding to a particular base at an interrogation position within the probe). In a preferred embodiment, to determine the identity of a base of each DNB disposed on the surface, each field of view ("frame") is imaged with four different wavelengths corresponding to the four fluorescently labeled sequencing probes. All images from each cycle are saved in digital form in a cycle directory, where the number of images is four times the number of frames (where four fluorophores are used). Cycle image data can then be saved into a directory structure organized for downstream processing.

In some embodiments, data extraction will rely on two types of image data: bright-field images to demarcate the positions of all DNBs on a surface, and sets of fluorescence images acquired during each sequencing cycle. Data extraction software can be used to identify all objects with the bright-field images and then for each such object, the software can be used to compute an average fluorescence value for each sequencing cycle. For any given cycle, there are four data points corresponding to the four images taken at different wavelengths to query whether that base is an A, G, C or T. These raw data points (also referred to herein as "base calls") are consolidated, yielding a discontinuous sequencing read for each DNB. This read may contain errors due to the ambiguity of the decision-making process in the base call.

Therefore, according to the invention, error correction 40 is invoked to yield corrected base calls 46. The error correction processes use a class of linear block cyclic symbol-based error correction methods. The methods are based on the use of run-length limited codes of the type known as the Reed-Solomon codes. Reed-Solomon codes have been explained at length in the mathematics and communication literature. Reference is made to the seminal paper "Polynomial Codes Over Certain Finite Fields," by I. S. Reed and G. Solomon, *SIAM Journal of Applied Math.*, vol. 8, 1960, pp. 300-304 for the mathematical basis. Further reference is made to textbooks for an explanation of the implementation, such as *Digital Communications: Fundamentals and Applications, Second Edition*, by Bernard Sklar (Prentice-Hall, 2001). A brief tutorial on the use of Reed-Solomon codes based on an explanation by Sklar is provided as follows.

Reed-Solomon codes are nonbinary cyclic codes with symbols made up of m-bit sequences, where m is any positive integer having a value greater than 2. RS(n, k) codes on m-bit symbols exist for all n and k for which $$0 < k < n < 2^m + 2 \quad (1),$$

where k is the number of data symbols being encoded, and n is the total number of code symbols in the encoded block. For the most conventional Reed-Solomon, or RS(n, k) code, $$(n,k) = (2^m - 1, 2^m - 1 - 2t) \quad (2)$$

where t is the symbol-error correcting capability of the code, and n−k=2t is the number of parity symbols. An extended Reed-Solomon code can be made up with $n=2^m$ or $n=2^m+1$, but not any further.

Reed-Solomon codes achieve the largest possible code minimum distance for any linear code with the same encoder input and output block lengths. For nonbinary codes, the distance between two code words is defined as the number of symbols in which the sequences differ. For Reed-Solomon codes, the code minimum distance is given by:

$$d_{min} = n - k + 1 \quad (3)$$

The code is capable of correcting any combination of t or fewer errors, where t can be expressed as:

$$t = \lfloor (d_{min} - 1)/2 \rfloor = \lfloor (n-k)/2 \rfloor \quad (4)$$

where the center portion of this equation "x" means the largest integer not to exceed x. Equation (4) illustrates that for the case of Reed-Solomon codes, correcting t symbol errors requires no more than 2t parity symbols. Equation (4) lends itself to the following intuitive reasoning. One may say that the decoder has n−k redundant symbols to "spend," which is twice the amount of correctable errors. For each error, one redundant symbol is used to locate the error, and another redundant symbol is used to find its correct value. The correction is known as an erasure, which is equivalent to a no-call-correcting capability.

The erasure or no-call-correcting capability ρ of the code is:

$$\rho = d_{min} - 1 = n - k \quad (5)$$

Simultaneous error-correction and erasure-correction capability can be expressed as follows:

$$2\alpha + \gamma < d_{min} < n - k \quad (6)$$

where α is the number of symbol-error patterns that can be corrected and γ is the number of symbol erasure patterns that can be corrected. An advantage of nonbinary codes such as a Reed-Solomon code can be seen by the following comparison. Consider a binary (n, k)=(7, 3) code. The entire n-tuple space contains $2n=2^7=128$ n-tuples, of which $2k=2^3=8$ (or 1/16 of the n-tuples) are code words. Next, consider a nonbinary (n, k)=(7, 3) code where each symbol is composed of m=3 bits. The n-tuple space amounts to $2nm=2^{21}=2,097,152$ n-tuples, of which $2km=2^9=512$ (or 1/4096 of the n-tuples) are code words. When dealing with nonbinary symbols, each made up of m bits, only a small fraction (i.e., 2km of the large number 2nm) of possible n-tuples are code words. This fraction decreases with increasing values of m. The important point here is that when a small fraction of the n-tuple space is used for code words, a large $d_{min}$ can be created.

Reed-Solomon codes have the remarkable property that they are able to correct any set of n−k symbol erasures within the block, erasure being equivalent to a no-call. Reed-Solomon codes can be designed to have any redundancy. However, the complexity of a high-speed implementation increases with redundancy. Thus, the more attractive Reed-Solomon codes have high code rates (low redundancy).

Referring now a specific implementation of the invention, Reed-Solomon error detection and Reed-Solomon error correction is based on selection and use of a specific error-correcting code that in general works by oversampling a polynomial constructed from the data. In the present context, the coefficients of the polynomial are the base call designations from fluorophore-label identification in the base calling analysis coded as integers, e.g., 1,2,3,4, which has been made redundant in nature by the overlapping probes, where the redundancy comes from the length of the probes. As noted, sampling the polynomial more often than is necessary makes the polynomial over-determined. So long as more than a minimum number of the samples is correct, the original polynomial can be recovered in the presence of some bad points. As noted, the relationship between good and bad points determines the number of errors that can be corrected, which for k bases, with n−k redundant bases, have the following properties: where 2t=n−k and the location of the error is not known, t errors can be identified and corrected. Where location of the errors is known, then 2t errors can be corrected. In other words, Reed-Solomon methodology can correct half as many errors as there are redundant symbols in a block when location of errors is not known and if location is known, it can correct as many errors as there are redundant symbols. The method according to the invention relies on generating a correction code set wherein each random pair from the code set is guaranteed to have a minimum ratio R of distance D to length L of greater than 20 percent from every other member of the set. The distance D greater than or equal to 3 for length L equal to 10, namely a 10 base code. Similarly the distance D greater than or equal to 3 for length L equal to 7, namely a 7 base code.

Location of errors can be identified by base reference to the base calling quality score. the base calling quality score can be obtained directly from commercially available base calling algorithms. A paper describing one commercially available technique was newly published in the aforementioned Drmanac et al., "Human Genome Sequencing Using Unchained Base Reads on Self-Assembling DNA Nanaoarrays," *Science*, Vol. 327, pp. 78-81, Jan. 1, 2010 (also found online at www.scienceexpress.org, dated 5 Nov. 2009, Page 1 (10.1126/science.1181498.) This paper is incorporated herein by reference.

Significantly, since Reed-Solomon block codes can correct block errors, it can therefore be used to correct for errors in base identification, unlike Hamming block codes, which can correct only for bit errors.

For DNA reading applications, it is typically thought desirable that the value of "n" be kept small, since the value of "n" ultimately defines the number of bases in the final code, and the value needs to be small to minimize the cost of the assay. Further, the probability of a base read cannot be so high that the sequencing technology cannot be enabled. In the most efficient case, the value of t, the number of errors that is to be corrected in any one iteration, is set to "1". In a further case, 10-base codes may be provided that are able to correct 2 errors. Thus, the artifical 10-mer set that can correct for two errors is as follows:

| | |
|---|---|
| CAGCAAGCAG | (SEQ ID NO: 1551) |
| GGAGAAAACG | (SEQ ID NO: 9) |
| CGGGAACAAA | (SEQ ID NO: 257) |
| CACCCACAGC | (SEQ ID NO: 266) |
| AACAGACGAC | (SEQ ID NO: 2342) |
| TTTAACATGC | (SEQ ID NO: 3128) |
| TCTCACCAGT | (SEQ ID NO: 319) |
| CCAACCCAGA | (SEQ ID NO: 325) |
| AGCCCCAGGG | (SEQ ID NO: 2131) |
| GCCGCCCGAC | (SEQ ID NO: 2396) |
| CGCAGCAAAG | (SEQ ID NO: 94) |
| ACACGCCGAA | (SEQ ID NO: 2408) |
| TGGGTCTTAC | (SEQ ID NO: 3955) |
| CAAAAGCAAG | (SEQ ID NO: 377) |
| GAGAAGAACA | (SEQ ID NO: 127) |
| TGTAAGAGCT | (SEQ ID NO: 2182) |
| ACCACGCACG | (SEQ ID NO: 393) |
| CGACCGAGCA | (SEQ ID NO: 2197) |
| GGGCCGCGAG | (SEQ ID NO: 2459) |
| ACGGCGAGGC | (SEQ ID NO: 2204) |
| TGTGCGGCAT | (SEQ ID NO: 1698) |
| CTGGGGCTAT | (SEQ ID NO: 3494) |
| TCCCTGTTAG | (SEQ ID NO: 4023) |
| TTCTATCAGC | (SEQ ID NO: 456) |
| TTGTCTGCAG | (SEQ ID NO: 1761) |
| CGTTGTCTAG. | (SEQ ID NO: 3563) |

The hardware basis for implementing Reed-Solomon codes has been detailed elsewhere for communication applications. Reference is made to "Reed-Solomon Error Correction," by C. K. P. Clarke, *BBC Research & Development White Paper WHP* 031, July 2002, (British Broadcasting Corporation), incorporated by reference herein for all purposes and attached hereto for convenience as Appendix A. This white paper describes the principles of a general purpose hardware implementation of an error correcting device using Reed-Solomon coded data as input. In the present context, once a polynomial has been constructed from the DNA base call data, it is processed by circuitry such as that disclosed by Clarke to recover the DNA tags.

It should be understood that the implementation of this invention is only practical in the context of use of a dedicated or a general purpose computer processor. In addition to a hardware implementation of the Reed-Solomon decoder as described in Appendix A, a Reed-Solomon-code-based decoder may also be implemented through a computer program of a general-purpose digital computer. Representative source code that is in MATLAB source code form (MATLAB 7.9.0/529 (R2009b) for representative Reed-Solomon code designs is set forth below. This includes a 10 10 base code design with one error correction capability and a 7 base R-S decoder:

---
10 10base code design
---

```
v.m = 4;      % Number of bits per symbol
v.n = 2^v.m−1; % Codeword length
v.k = 13;
v.n0 = 10;
v.s = v.n − v.n0;
v.k0 = v.k − v.s;
v.t = (v.n−v.k)/2;  % Error-correction capability of the code
% Coder/Decoder Construction
coder = fec.rsenc(v.n, v.k);
coder.ShortenedLength = v.s;
decoder = fec.rsdec(coder);
%% Construct full data set
v.data0 = fullfact(4*ones(1,v.k0));
v.nwords0 = size(v.data0,1); % number of words to process
%% Construct message
v.send0 = encode(coder, v.data0')'; % Encode the data.
%% Select the valid codes
v.valid = all(ismember(v.send0,[1 2 3 4]),2);
v.data = v.data0(v.valid,:);
v.nwords = size(v.data,1);
v.send = v.send0(v.valid,:);
v.seq = int2nt(v.send);
```

---
Reed-Solomon Decoder (7base)
---

```
function [decoded_integer, decoded0_integer, status, recovery] =
reed_solomon_decoder_7base(sequence_corrupted_integer, erasures)
v.m = 3;    % Number of bits per symbol
v.n = 2^v.m−1; % Codeword length
v.k = 5;    % message length
v.t = (v.n−v.k)/2;  % Error-correction capability of the code
% Coder/Decoder Construction
coder = fec.rsenc(v.n, v.k);
decoder = fec.rsdec(coder);
u.seq_corrupted_integer = double(sequence_corrupted_integer);
u.erasures = erasures;
[dummy, nerrors, seq_corrected_integer] = decode(decoder,
     u.seq_corrupted_integer', u.erasures'); % Decode the noisy code.
u.seq_corrected_integer = seq_corrected_integer';
u.nerrors = nerrors';
recovery = (u.nerrors==1);
u.status = all(ismember(u.seq_corrected_integer,[1:4]),2) &
     ismember(u.nerrors,[0:v.t]);
decoded0_integer = u.seq_corrected_integer;
decoded_integer = decoded0_integer;
status = u.status;
decoded_integer(status==0,:) = 0;
```

The foregoing source code is applicable to each dataset below, including the following dataset for Reed-Solomon 6+4 base, 26 sequence, 2 base error correction, 4 nocall correction (SEQ ID NOS:1551, 9, 257, 266, 2342, 3128, 319, 325, 2131, 2396, 94, 2408, 3955, 377, 127, 2182, 393, 2197, 2459, 2204, 1698, 3494, 4023, 456, 1761, and 3563, respectively):

```
CAGCAAGCAG GGAGAAAACG CGGGAACAAA CACCCACAGC

AACAGACGAC TTTAACATGC TCTCACCAGT CCAACCCAGA

AGCCCCAGGG GCCGCCCGAC CGCAGCAAAG ACACGCCGAA

TGGGTCTTAC CAAAAGCAAG GAGAAGAACA TGTAAGAGCT

ACCACGCACG CGACCGAGCA GGGCCGCGAG ACGGCGAGGC

TGTGCGGCAT CTGGGGCTAT TCCCTGTTAG TTCTATCAGC

TTGTCTGCAG CGTTGTCTAG
```

The foregoing code set is also applicable to the following dataset for Reed-Solomon 8+2 base, 4096 sequence, 1 base error, 2 nocall correction (SEQ ID NOS:1-4096):

```
TAAAAAAAGG ATGAAAAACC CCACAAAAGC AGACAAAATT

CTACAAAATA ACCCAAAAGA ATCCAAAATC TGTCAAAATA

GGAGAAAACG AGGGAAAACA TGGGAAAAAG CTGGAAAACT

GGTGAAAAAT ACTTAAAACC ACAACAAAGC CGAACAAATT

ATAACAAATA CCCACAAAGA CTCACAAATC GTGACAAATG

TTTACAAATT GTCCCAAACG CTGCCAAACC GGTCCAAAAC

CCAGCAAAGT AGAGCAAATC CGCGCAAATA ATCGCAAATT

TAATCAAAAT GAGTCAAACT TCGTCAAATT AATTCAAAAA

TATTCAAACG GCTTCAAATG AGAAGAAACG TGAAGAAAAA

GGGAGAAACA AGTAGAAAAT CTTAGAAAAA GCACGAAAGT

GGCCGAAATA TTAGGAAAAC TGCGGAAAAT CTCGGAAACG

TAGGGAAAGA GTGGGAAACC CGTGGAAAAC CAATGAAATA

AACTGAAATC CCGTGAAAAA CCCATAAACT GATATAAATC

TCTATAAACC CAACTAAAAT CCGCTAAATT AGGCTAAAGC

CATCTAAACG CCAGTAAACA ACCGTAAACC AAATTAAAGG

GTATTAAAAC GGCTTAAAAT GAGTTAAAGA TTGTTAAACC

AAAAACAAGC GTAAACAAAG CACAACAAGA CGGAACAAAT

ATGAACAAAA TTGAACAACG GTTAACAACT TTCCACAATG

CAAGACAAGT AGGGACAAAC TCATACAAAT TAGTACAATT

GCGTACAACT GATTACAATG ACTTACAAAA TCTTACAACG

TCAACCAAGG CAACCCAAGC AACCCCAAGA AGGCCCAAAT

CTGCCCAAAA GGTCCCAACA TGAGCCAATG CTTGCCAATG

GTATCCAAGT GGCTCCAAGC CGGTCCAAGG AATTCCAACC

TGAAGCAACC CGCAGCAAAG TTCAGCAACT GGGAGCAAAC

CTTAGCAACC TTGCGCAATT GTTCGCAATG GAAGGCAAGC

ATAGGCAAAG TTAGGCAACA GTGGGCAAAA CGTGGCAACA

ATTGGCAACT TACTGCAATG GCCTGCAACG CCGTGCAACC

ACAATCAAAT AAGATCAATT ACTATCAACG TCTATCAAAA

AACCTCAACT TGGCTCAAGG GGTCTCAAGT CCAGTCAAAC

GACGTCAATG ACCGTCAAAA TCCGTCAACG CAGGTCAATC

TAATTCAAGC GTATTCAACA ATGTTCAACG TTGTTCAAAA

AAAAGAACG TAAAAGAAAA GAGAAGAACA TCGAAGAATA

TTGAAGAAGC AATAAGAAAT GACCAGAATA ACCCAGAAAG

TCCCAGAACA TACGAGAAAT TGGGAGAAGA CATGAGAAAC

CGATAGAATA ATATAGAATT CCCTAGAAGT AGCTAGAATC

TCTTAGAAGC TTTTAGAATA GAAACGAATC TCAACGAACC

CCCACGAAAG GCGACGAAAC CAACCGAACG TACCCGAAAC

CATCCGAAAT CCTGCGAACA GGCTCGAACG CGGTCGAACC

AATTCGAAGG GTTTCGAAAC TGAAGGAAGG CTTAGGAAGG

AAACGGAATT ACGCGGAAAT TATCGGAATA GCTCGGAACA

GAAGGGAACG TCAGGGAATG AAGGGGAACA TAGGGGAAAG

GATGGGAAAT GCCTGGAAGC GTCTGGAATA CCGTGGAAGG

TTAATGAATT TGCATGAATC ACTATGAAGC CGTATGAATT

ATTATGAATA GGACTGAAAC GTCCTGAAAT TGGCTGAACC

TCCGTGAAGC TTCGTGAATA CCTGTGAAGT AGTGTGAATC

AAATTGAAAA TAATTGAACG GCATTGAATG CACTTGAAAC

GAGTTGAAAG ACGTTGAATA ATGTTGAAGC TATTTGAAAT

GCTAATAAGA GTTAATAATC AGACATAAAA TGACATAACG

CTACATAAAT CGCCATAAAC GGGCATAAAG TGTCATAAAT

CTTCATAACG GGTGATAATA GAATATAAAC ATATATAAGG

CCCTATAATG TAGTATAACC GCGTATAATC GTGTATAAGA

CGAACTAAAA ATAACTAAAT AGCACTAAAC ATTACTAACG

TTTACTAAAA CTAGCTAAAC CGCGCTAAAT ATCGCTAAAA

TTCGCTAACG CAGGCTAAGA TGTGCTAAAC TAATCTAATA

GCATCTAACA ACGTCTAACG TCGTCTAAAA AATTCTAATT

TGAAGTAATT TCCAGTAAGA TTCAGTAATC AGTAGTAATA

CTTAGTAATT AAACGTAAGG GTACGTAAAC GGCCGTAAAT

GAGCGTAAGA TTGCGTAACC TCAGGTAAGT TGCGGTAATA

ACTGGTAAGA ATTGGTAATC CAATGTAAAT CCGTGTAATT

AGGTGTAAGC CATTGTAACG TTAATTAAGG AAGATTAACC

CGTATTAAGG CAACTTAATA AACCTTAATC CCGCTTAAAA

CAGGTTAACT CCTGTTAATG GCATTTAAGT GGCTTTAATA

CAAAAACAGA AACAAACAGC GTCAAACAAG CTGAAACAAC

GGTAAACACC TTACAACATG CGTCAACATG CACGAACAGT

CGGGAACAAA ATGGAACAAT TATGAACAGC GTTGAACACA

TCCTAACAAT CCTTAACAAC TCCACACAGG AGTACACATG

AAACCACAGA CACCCACAGC GAGCCACAGG ATGCCACAAC

TATCCACAGT TGCGCACATG ACTGCACAGG GGATCACAGC

GTCTCACAGT CATTCACACA CGAAGACAAG TTAAGACACT

TGCAGACACC GTGAGACAAT CGTAGACACT ATTAGACACA

TTTAGACAAG TGGCGACATC GACGGACAGC ATCGGACAAG
```

-continued

```
TTCGGACACA CAGGGACAGG AGTGGACACC TAATGACATG
GCATGACACG ACGTGACACA TCGTGACAAG GCTTGACAAT
ACCATACAAT AAACTACACT AATCTACAAG TATCTACACA
GCTCTACATA GTTCTACAGC GAAGTACATG ACAGTACAAA
TCAGTACACG CCCGTACAAC AAGGTACATA GCGGTACAAG
TCTGTACAAT TACTTACAGC GTCTTACACA CATTTACAGT
TACAACCAGG AGGAACCACT CTGAACCACA GGTAACCAAA
ACACACCAGA ATACACCATC CCCCACCAGC AGCCACCATT
CTCCACCATA GCGCACCAGG TCTCACCAGT GGCGACCACG
CGGGACCACC AATGACCAGG GTTGACCAAC CCTTACCACA
CCAACCCAGA CTAACCCATC ACCACCCAGC CGCACCCATT
ATCACCCATA TGTACCCATC GTACCCACG CGGCCCCACT
ATGCCCCACA TTGCCCCAAG GTTCCCCAAT CGAGCCCATA
ATAGCCCATT CCCGCCCAGT AGCGCCCATC TCTGCCCAGC
TTTGCCCATA TACTCCCAAT TGGTCCCAGA CATTCCCAAC
AGCAGCCACG TGCAGCCAAA TAGAGCCAGT GATAGCCAGG
ATTAGCCAAC GGACGCCATA GCCCGCCAGT AGGCGCCATG
TGAGGCCAAT CTAGGCCACG TTCGGCCAAC GGGGGCCACT
AGTGGCCAAA TGTGGCCACG CTTGGCCAAT AAATGCCATC
CACTGCCATA ACGTGCCAAC CCAATCCACT CCTATCCAAG
CACCTCCAAT CGGCTCCAGA ATGCTCCAGT TATCTCCAAC
ACAGTCCACC CCCGTCCACA GGATTCCAAT AACTTCCAGG
GTCTTCCAAC TGGTTCCACT CTGTTCCAAG GGTTTCCACG
CAAAAGCAAG TACAAGCACC GCCAAGCATC GTCAAGCAGA
CCGAAGCATG CATAAGCACT TCACAGCAAC CCCCAGCACG
TAGCAGCATC GCGCAGCACC GTAGAGCAGT GGCGAGCAGC
CGGGAGCAGG AATGAGCACC TGATAGCATG CTTTAGCATG
ACCACGCACG TCCACGCAAA AAACCGCAAG TAACCGCACA
GCACCGCATA GTACCGCAGC GGCCCGCAGT GAGCCGCAAA
ACGCCGCATG AATCCGCACT TCAGCGCAAT TAGGCGCATT
GCGGCGCACT GATGCGCATG ACTGCGCAAA TCTGCGCACG
CAATCGCAGT AGGTCGCAAC CGAAGGCAGA ATAAGGCAGT
CCCAGGCATT AGCAGGCAGC GATAGGCACC TCTAGGCATC
TTTAGGCAGA CCGCGGCACT CATCGGCATG CCAGGGCATA
CTAGGGCAGC ACCGGGCATC CGCGGGCAGT ATCGGGCAGA
CAGGGGCAAA TGTGGGCAGC TCGTGGCAGA TTGTGGCATC
AGAATGCATG GGGATGCATA TAACTGCAGT GGCCTGCACA
AATCTGCAGA ACAGTGCAGG CTCGTGCATG GCGGTGCAGA
GTGGTGCATC CAATTGCACA AACTTGCACC GGTTTGCAGC
CCGAATCAGT AGGAATCATC CGACATCACA ATACATCACT
AGCCATCACC GATCATCAGC ATTCATCAAG TTTCATCACA
```

```
GTAGATCATG ACGGATCAGC CGGGATCATT ATGGATCATA
TGATATCAGT GACTATCACA TCCTATCATA TTCTATCAGC
AGTTATCAGA CTTTATCAGT AGAACTCACA TGAACTCAAG
CTAACTCACT CGCACTCACC GGGACTCACG TGTACTCACT
CTTACTCAAG GGCCCTCATG ACGCCTCAGT CGGCCTCATC
ATAGCTCACC AGCGCTCACT CTCGCTCACA TAGGCTCAGG
GATGCTCAGT CAATCTCATG GCCTCTCAAC CCGTCTCAAG
ATAAGTCATG CCCAGTCAGG GCGAGTCAGC GTGAGTCATA
TACCGTCAGC GTCCGTCACA CATCGTCAGT CGCGGTCATG
GGGGGTCATC AAATGTCACT AATTGTCAAG TATTGTCACA
GCTTGTCATA GTTTGTCAGC CCAATTCATC AGAATTCAGT
CTAATTCAGA GACATTCAAG ACCATTCATA ATCATTCAGC
CAGATTCAAC TGTATTCAGA TAACTTCATG GCACTTCACG
ACGCTTCACA TCGCTTCAAG GCTCTTCAAT ACAGTTCATT
CGAGTTCAGC AGCGTTCAGA CTCGTTCAGT AAGGTTCAAT
GATGTTCACA TCTGTTCATA TTTGTTCAGC TGGTTTCATC
GAAAAGACA TCAAAGATA TTAAAGAGC TGCAAAGAGT
AAGAAAGACG TAGAAAGAAA ACTAAAGATT CGTAAAGAGC
AACCAAGATG GCCCAAGAAA TGAGAAGAGA GACGAAGACT
TCCGAAGATT CCTGAAGATC AGTGAAGAGT CTTGAAGAGA
CGGTAAGATA ATGTAAGATT GCAACAGAAC CACACAGATG
GAGACAGATC TCGACAGACC GACCCAGACC TCCCCAGATC
TTCCCAGAGA CAGCCAGACG CCTCCAGATT AGTCCAGAGC
CGATCAGACC AGCTCAGACA TGCTCAGAAG CTCTCAGACT
GATTCAGAGA TTTTCAGACC AACAGAGACT TGGAGAGAGG
GGTAGAGAGT ACACGAGAAT AAGCGAGATT ACTCGAGACG
TCTCGAGAAA AAAGGAGACA TAAGGAGAAG CACGGAGACC
GAGGGAGACG TCGGGAGATG TATGGAGACT GCTGGAGATT
CCATGAGAGG ATCTGAGATG TTGATAGATT GTTATAGATG
TGACTAGACC CGCCTAGAAG TTCCTAGACT GGGCTAGAAC
CTTCTAGACC GAATTAGAAG ACATTAGATA ATATTAGAGC
CCCTTAGATC AGCTTAGAGT CTCTTAGAGA AAGTTAGAAA
TAGTTAGACG GCGTTAGATG GATTTAGACT TCTTTAGATT
GAAAACGAAC ATAAACGAGG CCCAACGATG TAGAACGACC
GCGAACGATC GTGAACGAGA TACCACGATC GCCCACGACC
CCGCACGACG CATCACGATT CGCGACGAGG GGGGACGAGC
GCTTACGAGA GTTTACGATC TAAACCGATA GCAACCGACA
ACGACCGACG TCGACCGAAA AATACCGATT CTACCCGAGG
GACCCGAAA ACCCCCGATG GGGCCCGAGT TGTCCCGAGG
TACGCCGATT GCCGCCGACT CATGCCGATC CGATCCGAAA
```

-continued

```
ATATCCGAAT AGCTCCGAAC ATTTCCGACG TTTTCCGAAA
CAAAGCGAAT CCGAGCGATT AGGAGCGAGC CATAGCGACG
CCCCGCGACT GATCGCGATC TCTCGCGACC AAAGGCGAAC
GTAGGCGAGG CACGGCGAAA ACGGGCGATC CGGGGCGAGT
ATGGGCGAGA TGATGCGATT TCCTGCGAGA TTCTGCGATC
AGTTGCGATA CTTTGCGATT GCAATCGAGT GGCATCGATA
AGACTCGACG TGACTCGAAA GGGCTCGACA AGTCTCGAAT
CTTCTCGAAA GGAGTCGATT GCCGTCGAGA GTCGTCGATC
CTGGTCGATG TTATTCGAGG AAGTTCGACC CGTTTCGAGG
ATAAAGGACC AGCAAGGACT CTCAAGGACA TAGAAGGAGG
GATAAGGAGT GCCCAGGAGG CCGCAGGAGC AGGCAGGATT
CTGCAGGATA AGAGAGGACA TGAGAGGAAG CTAGAGGACT
CGCGAGGACC GGGGAGGACG TGTGAGGACT CTTGAGGAAG
GTAACGGATG ACGACGGAGC CGGACGGATT ATGACGGATA
CTACCGGACC CGCCCGGACT ATCCCGGACA TTCCCGGAAG
TGTCCGGACC CCGGCGGAGT AGGGCGGATC GAATCGGACT
TCATCGGATT TGCTCGGAGA TAGTCGGAAT GATTCGGAAG
ACTTCGGATA ATTTCGGAGC GGAAGGGACA TACAGGGAGT
AGGAGGGACG TGGAGGGAAA CATAGGGAGC AGCCGGGATG
GCGCGGGAGT TCTCGGGAGG TAAGGGAGA GTAGGGGACC
GGCGGGGACT TTGGGGGAAC AATGGGGAGT CCATGGGAAA
ACCTGGGAAC CAGTGGGATA GCTATGGAAC CCACTGGATT
AGACTGGAGC CGCCTGGAGA ATCCTGGAGT CAGCTGGAAT
CCGGTGGACA GAATTGGAGA TTATTGGACC TGCTTGGACT
CTCTTGGAAG AAGTTGGAGG GTGTTGGAAC CGTTTGGACC
TCAAATGAAT TAGAATGATT GCGAATGACT GATAATGATG
ACTAATGAAA TCTAATGACG GGACATGAGA TACCATGACT
GCCCATGATT AGGCATGAGG CATCATGACC ACCGATGACG
TCCGATGAAA AAATATGAGC GTATATGAAG CACTATGAGA
CGGTATGAAT ATGTATGAAA TTGTATGACG GTTTATGACT
GTAACTGAGT GGCACTGAGC CGGACTGAGG AATACTGACC
CCTCCTGAAA CAAGCTGAAG TACGCTGACC GCCGCTGATC
GTCGCTGAGA CCGGCTGATG CATGCTGACT TCATCTGAGG
TACAGTGATG GCCAGTGACG CCGAGTGACC GAACGTGAAG
ACACGTGATA ATACGTGAGC CCCCGTGATC AGCCGTGAGT
CTCCGTGAGA AAGCGTGAAA TAGCGTGACG GCGCGTGATG
GATCGTGACT TCTCGTGATT ACGGGTGACT AATGGTGATG
GCTGGTGAAA TGATGTGACC CGCTGTGAAG TTCTGTGACT
GGGTGTGAAC CTTTGTGACC TAAATTGAGC GTAATTGACA
ATGATTGACG TTGATTGAAA CCACTTGAGG ATCCTTGATG
GGAGTTGACC GTCGTTGACT TGGGTTGAAC CATGTTGAGA
```

```
ACATTTGAAT AAGTTTGATT ACTTTTGACG TCTTTTGAAA
GCAAAATAGA GTAAAATATC GGCAAATATT ACGAAATAGG
TGACAATAAT CTACAATACG TTCCAATAAC GGGCAATACT
AGTCAATAAA TGTCAATACG CTTCAATAAT GGAGAATATA
GCCGAATAGT AGGGAATATG GATTAATAAC ATTTAATAGG
ATAACATACG TTAACATAAA TAGACATAGC GTGACATACA
CGTACATAAA ATTACATAAT GCCCCATAGC GTCCCATATA
CCGCCATAGG TGAGCATAAC CGCGCATACG TTCGCATAAT
GGGGCATACC CTTGCATAAC AAATCATATT ACGTCATAAT
TATTCATATA GCTTCATACA AGAAGATATA CTAAGATATT
ACCAGATAGT CGCAGATATC GGGAGATATG TGTAGATATT
GGCCGATACG CGGCGATACC AATCGATAGG GTTCGATAAC
ACAGGATAGA ATAGGATATC CCCGGATAGC AGCGGATATT
CTCGGATATA GCGGGATAGG TCTGGATAGT CAATGATACG
TACTGATAAC CATTGATAAT CGAATATAGG GTGATATAGT
TTTATATAGG CATCTATATA CCAGTATATG GACGTATAAC
ATCGTATAGG CAGGTATAAG TCGTTATAGG GCTTTATAGT
TCGAACTAGC TTGAACTATA GACCACTAGC ATCCACTAAG
TTCCACTACA CAGCACTAGG AGTCACTACC TGGGACTATC
ACATACTATT CGATACTAGC AGCTACTAGA CTCTACTAGT
AAGTACTAAT GATTACTACA TCTTACTATA TTTTACTAGC
GAAACCTAGA TTAACCTACC TGCACCTACT CTCACCTAAG
AAGACCTAGG GTGACCTAAC CGTACCTACC TGGCCCTATT
GGTCCCTATG AGAGCCTAAG TGAGCCTACA GACGCCTAGT
GGGGCCTAAA AGTGCCTACT CTTGCCTACA GCTTCCTAAC
CCTAGCTAGG CACCGCTAGT CGGCGCTAAA ATGCGCTAAT
TATCGCTAGC GTTCGCTACA TTAGGCTATG CGTGGCTATG
GGATGCTAGT AACTGCTAAG TACTGCTACA GCCTGCTATA
GTCTGCTAGC CTGTGCTAGG GAAATCTACT TCAATCTATT
TGCATCTAGA TAGATCTAAT GATATCTAAG ACTATCTATA
ATTATCTAGC GCCCTCTAAT TGAGTCTAGT GACGTCTACA
TCCGTCTATA TTCGTCTAGC AGTGTCTAGA CTTGTCTAGT
GTATTCTATG ACGTTCTAGC CGGTTCTATT ATGTTCTATA
AAAAAGTATA GCAAAGTAAG CACAAGTATC GAGAAGTATG
ACGAAGTAAA TCGAAGTACG TATAAGTATT GCTAAGTACT
GACCAGTACG TCCCAGTATG CAGCAGTACC AGTCAGTAGG
AACGAGTATT CGATAGTACG TTATAGTAAT TGCTAGTAAC
GTGTAGTACT CGTTAGTAAT ATTTAGTAAA TTTTAGTACG
TTAACGTAGG AAGACGTACC CGTACGTAGG CAACCGTATA
AACCCGTATC CCGCCGTAAA CAGGCGTACT CCTGCGTATG
```

-continued

```
GCATCGTAGT GGCTCGTATA GACAGGTATT TCCAGGTACT
CCTAGGTACC TAACGGTAAT GAGCGGTACT TCGCGGTATT
AATCGGTAAA TATCGGTACG GCTCGGTATG GAAGGGTATA
ACAGGGTAAG TCAGGGTACA AAGGGGTATG GCGGGGTAAA
ACTGGGTACT GTCTGGTACG CTGTGGTACC GGTTGGTAAC
CGAATGTAAA ATAATGTAAT AGCATGTAAC ATTATGTACG
TTTATGTAAA CTAGTGTAAC CGCGTGTAAT ATCGTGTAAA
TTCGTGTACG CAGGTGTAGA TGTGTGTAAC TAATTGTATA
GCATTGTACA ACGTTGTACG TCGTTGTAAA AATTTGTATT
GGCAATTAAA GAGAATTAGT TATAATTAGG TGACATTATA
TCCCATTAGT CCTCATTAGC AGTCATTATT CTTCATTATA
GGAGATTAAT AACGATTAGG GTCGATTAAC TGGGATTACT
CTGGATTAAG GGTGATTACG ACATATTACC CCCTATTACA
TTAACTTATT TGCACTTATC ACTACTTAGC CGTACTTATT
ATTACTTATA GGACCTTAAC GTCCCTTAAT TGGCCTTACC
TCCGCTTAGC TTCGCTTATA CCTGCTTAGT AGTGCTTATC
AAATCTTAAA TAATCTTACG GCATCTTATG CACTCTTAAC
GAGTCTTAAG ACGTCTTATA ATGTCTTAGC TATTCTTAAT
AGAAGTTAAT CTAAGTTAAA GACAGTTAGG ATCAGTTAAC
CAGAGTTAGC AGTAGTTACG TGTAGTTAAA TCGCGTTAGG
GCTCGTTAGT CGAGGTTAAC AGCGGTTAAA TGCGGTTACG
CTCGGTTAAT AAGGGTTAGT TTTGGTTAAC CATTGTTATA
GAAATTTATC TCAATTTACC CCCATTTAAG GCGATTTAAC
CAACTTTACG TACCTTTAAC CATCTTTAAT CCTGTTTACA
GGCTTTTACG CGGTTTTACC AATTTTTAGG GTTTTTTAAC
TTAAAAACTG CGTAAAACTG CAACAAACGA AACCAAACGC
GTCCAAACAG CTGCAAACAC GGTCAAACCC CCTGAAACGG
TAATAAACCT GCATAAACTT GGCTAAACGA GAGTAAACAT
AATTAAACCA TATTAAACAG AAAACAACGA CACACAACGC
GAGACAACGG ATGACAACAC TATACAACGT TCCCCAACGG
AGTCCAACTG GGAGCAACAG AACGCAACGT AGGGCAACAA
TGGGCAACCG CTGGCAACAT GGTGCAACCT ACTTCAACAC
TGGAGAACTC CGACGAACAG TTACGAACCT TGCCGAACCC
GTGCGAACAT CGTCGAACCT ATTCGAACCA TTTCGAACAG
TCGGGAACGC TTGGGAACTA CCATGAACTC AGATGAACGT
CTATGAACGA GACTGAACAG ACCTGAACTA ATCTGAACGC
CAGTGAACAC TGTTGAACGA AAAATAACCT AATATAACAG
TATATAACCA GCTATAACTA GTTATAACGC ACCCTAACAT
CAAGTAACCC AACGTAACCA TACGTAACAG GGTGTAACGA
ATATTAACTG CCCTTAACGG GCGTTAACGC GTGTTAACTA
ACAAACACGA ATAAACACTC CCCAACACGC AGCAACACTT
```

-continued

```
CTCAACACTA GCGAACACGG TCTAACACGT TACCACACGG
AGGCACACCT CTGCACACCA GGTCACACAA AGAGACACTA
CTAGACACTT ACCGACACGT CGCGACACTC GGGGACACTG
TGTGACACTT TTGTACACGT AATTACACAC GTTTACACGG
GTAACCACCG CGGACCACCT ATGACCACCA TTGACCACAG
GTTACCACAT CCACCCACGA CTACCCACTC ACCCCACGC
CGCCCCACTT ATCCCCACTA TGTCCCACTC AGGGCCACCC
CATGCCACGG GAATCCACTT TCATCCACCT GCGTCCACAT
ACTTCCACCA TCTTCCACAG GGAAGCACTA GCCAGCACGT
AGGAGCACTG AGCCGCACCG TGCCGCACAA TAGCGCACGT
GATCGCACGG ATTCGCACAC GCAGGCACGA GTAGGCACTC
GGCGGCACTT ACGGGCACGG TTCTGCACGG CAGTGCACCA
CACATCACAT CGGATCACGA ATGATCACGT TATATCACAC
CCACTCACCT CCTCTCACAG CAAGTCACAA AACGTCACAC
GTCGTCACGG CCGGTCACTA CTGGTCACGC TCATTCACGA
TTATTCACTC TGCTTCACTT ACTTTCACGT CGTTTCACTC
TCAAAGACAC CCCAAGACCG TAGAAGACTC GCGAAGACCC
CAACAGACAG TACCAGACCC GCCCAGACTC GTCCAGACGA
CCGCAGACTG CATCAGACCT CCTGAGACAA AAATAGACGT
GGCTAGACAG CGGTAGACAC TATTAGACGA GTTTAGACCC
AAAACGACAG TAAACGACCA GCAACGACTA GTAACGACGC
GGCACGACGT GAGACGACAA ACGACGACTG AATACGACCT
ACCCCGACCG TCCCCGACAA GGAGCGACGA TACGCGACCT
GCCGCGACTT AGGGCGACGG CATGCGACCC ATTTCGACTG
CCGAGGACCT CATAGGACTG CGACGGACGA ATACGGACGT
CCCCGGACTT AGCCGGACGC GATCGGACCC TCTCGGACTC
TTTCGGACGA ACGGGGACCC TGATGGACCT CTATGGACAG
GACTGGACGA TTCTGGACCC GGGTGGACAT AGTTGGACCA
TGTTGGACAG CTTTGGACCT TAAATGACGT GGCATGACCA
AATATGACGA AGACTGACTG GGGCTGACTA GGAGTGACCT
TACGTGACGA GTCGTGACCC TGGGTGACAT CTGGTGACCG
GGTGTGACAG ACATTGACAC CCCTTGACAA AAGTTGACTC
CGAAATACCA ATAAATACCT AGCAATACCC GATAATACGC
ATTAATACAG TTTAATACCA CCGCATACGT AGGCATACTC
CTAGATACCC CGCGATACCT ATCGATACCA TTCGATACAG
TGTGATACCC AAATATACTG GCATATACAA GAGTATACTA
ACGTATACAG TCGTATACCA GGCACTACTG ACGACTACGT
CGGACTACTC AGACCTACCA TGACCTACAG CTACCTACCT
CGCCCTACCC GGGCCTACCG TGTCCTACCT CTTCCTACAG
GCCGCTACGG CCGGCTACGC AGGGCTACTT CTGGCTACTA
```

-continued

```
GAATCTACCC TCATCTACTC TTATCTACGA TAGTCTACAC
CGTTCTACGA ATTTCTACGT TACAGTACGG GTCAGTACCA
CATAGTACGT ATACGTACTG CCCCGTACGG GCGCGTACGC
GTGCGTACTA GTAGGTACCT GGCGGTACCC CGGGGTACCG
TTGGGTACAT AATGGTACGC GTTGGTACAG ACCTGTACAT
TAAATTACTG GCAATTACCG ACGATTACCA TCGATTACAG
GCTATTACAT CCACTTACTC AGACTTACGT CTACTTACGA
GACCTTACAG ACCCTTACTA ATCCTTACGC CAGCTTACAC
TGTCTTACGA CGATTTACAG TTATTTACCT TGCTTTACCC
GTGTTTACAT CGTTTTACCT ATTTTTACCA TTTTTTACAG
CCAAAACCGC AGAAAACCTT CTAAAACCTA ACCAAACCGA
ATCAAACCTC TGTAAACCTA TAACAACCGG ATGCAACCCC
ACAGAACCGT CGAGAACCTC AGCGAACCTA CTCGAACCTT
TCTGAACCGA TTTGAACCTG TGGTAACCGC CATTAACCAA
GTCACACCCG CTGACACCCC GGTACACCAC ACACCACCGC
CGACCACCTT ATACCACCTA CCCCCACCGA CTCCCACCTC
GTGCCACCTG TTTCCACCTT CGGGCACCCA ATGGCACCCT
GTTGCACCAA GACTCACCTT CCTCACCCT CCTTCACCCC
GCAAGACCGT GGCAGACCTA AGACGACCCG TGACGACCAA
GGGCGACCCA AGTCGACCAT CTTCGACCAA GGAGGACCTT
GCCGGACCGA GTCGGACCTC CTGGGACCTG TTATGACCGG
AAGTGACCCC CGTTGACCGG CAAATACCAT CCGATACCTT
AGGATACCGC CATATACCCG CCCCTACCCT GATCTACCTC
TCTCTACCCC AAAGTACCAC GTAGTACCGG CACGTACCAA
ACGGTACCTC CGGGTACCGT ATGGTACCGA TGATTACCTT
TCCTTACCGA TTCTTACCTC AGTTTACCTA CTTTTACCTT
TTCAACCCTG AAACACCCGC GTACACCCAG CACCACCCGA
CGGCACCCAT ATGCACCCAA TTGCACCCCG GTTCACCCCT
ATTGACCCTG GGATACCCGA TACTACCCCT GCCTACCCTT
AGGTACCCGG CATTACCCCC CAAACCCGC AACACCCCGA
AGGACCCCAT CTGACCCCAA GGTACCCCA TCACCCCGG
AAAGCCCCGT GGCGCCCCAG CGGGCCCCAC TATGCCCCGA
GTTGCCCCCC CCTTCCCCAA TTGAGCCCTT GTTAGCCCTG
TGACGCCCCC CGCCGCCCAG TTCCGCCCCT GGGCGCCCAC
CTTCGCCCCC GAATGCCCAG ACATGCCCTA ATATGCCCGC
CCCTGCCCTC AGCTGCCCGT CTCTGCCCGA AAGTGCCCAA
TAGTGCCCCG GCGTGCCCTG GATTGCCCCT TCTTGCCCTT
AACATCCCCT TGGATCCCGG GGTATCCCGT ACACTCCCAT
AAGCTCCCTT ACTCTCCCCG TCTCTCCCAA AAAGTCCCCA
TAAGTCCCAG CACGTCCCCC GAGGTCCCCG TCGGTCCCTG
TATGTCCCCT GCTGTCCCTT CCATTCCCGG ATCTTCCCTG
GACAAGCCTA ACCAAGCCAG TCCAAGCCCA AAACAGCCCG
TAACAGCCAA GAGCAGCCCA TCGCAGCCTA TTGCAGCCGC
AATCAGCCAT GAAGAGCCTT TCAGAGCCCT GCGGAGCCAT
ACTGAGCCCA TCTGAGCCAG AGGTAGCCCC CATTAGCCGG
CAAACGCCCG TACACGCCAC CATACGCCAT GAACCGCCTC
TCACCGCCCC CCCCCGCCAG GCGCCGCCAC TTGGCGCCGT
AATGCGCCAC GTTGCGCCGG AGATCGCCTA CTATCGCCTT
ACCTCGCCGT CGCTCGCCTC GGGTCGCCTG TGTTCGCCTT
AAAAGGCCTT ACGAGGCCAT TATAGGCCTA GCTAGGCCCA
TGACGGCCGG CTTCGGCCAA CAAGGGCCTC AACGGGCCTA
GCCGGGCCAG CCGGGGCCAC ATATGGCCCG TTATGGCCAA
TAGTGGCCGC GTGTGGCCCA CGTTGGCCAA ATTTGGCCAT
GGAATGCCAC GTCATGCCAT TGGATGCCCC TTACTGCCTT
TGCCTGCCTC ACTCTGCCGC CGTCTGCCTT ATTCTGCCTA
GTAGTGCCAA CACGTGCCGG GAGGTGCCGC ATGGTGCCAG
TTGGTGCCCA CCATTGCCCC ACCTTGCCCA TCCTTGCCAG
AGAAATCCAA TGAAATCCCG CTAAATCCAT CGCAATCCAC
GGGAATCCAG TGTAATCCAT CTTAATCCCG GCTCATCCGA
GTTCATCCTC GAAGATCCGG ATAGATCCAC AGCGATCCAT
CTCGATCCAA AAGGATCCGA TACTATCCTC GCCTATCCCC
CCGTATCCCG CATTATCCTT CGACCTCCAA ATACCTCCAT
AGCCCTCCAC ATTCCTCCCG TTTCCTCCAA TTGGCTCCTG
GTTGCTCCTT CTATCTCCGG GACTCTCCAA ACCTCTCCTG
GGGTCTCCGT TGTTCTCCGG AAAAGTCCGG GTAAGTCCAC
GGCAGTCCAT GAGAGTCCGA TTGAGTCCCC TGACGTCCTT
TCCCGTCCGA TTCCGTCCTC AGTCGTCCTA CTTCGTCCTT
GGAGGTCCAA AGGGGTCCAG TGGGGTCCCA CCCTGTCCCT
GATTGTCCTC TCTTGTCCCC CAAATTCCTA AACATTCCTC
CCGATTCCAA TTACTTCCGG AAGCTTCCCC CGTCTTCCGG
CACGTTCCTT TATGTTCCTC GCTGTTCCCC AGATTTCCCG
TGATTTCCAA GGGTTTCCCA AGTTTTCCAT CTTTTTCCAA
TAAAAAGCTC GCAAAAGCCC TCGAAAGCAC CCACAAGCTG
GACCAAGCAC ATCCAAGCGG CAGCAAGCAG CATGAAGCTA
CGATAAGCAC AGCTAAGCAA TGCTAAGCCG CTCTAAGCAT
AAGTAAGCGT TTTTAAGCAC GAAACAGCAA ACAACAGCTG
CTCACAGCGG AAGACAGCAG TAGACAGCCA GCGACAGCTA
GTGACAGCGC TACCCAGCTA GCCCCAGCCA AGAGCAGCGG
GACGCAGCAT GGGGCAGCGA GCTTCAGCGC GTTTCAGCTA
CCAAGAGCCT CCTAGAGCAG CACCGAGCAT CGGCGAGCGA
ATGCGAGCGT TATCGAGCAC ACAGGAGCCC CCCGGAGCCA
```

-continued

GGATGAGCAT AACTGAGCGG GTCTGAGCAC TGGTGAGCCT
CTGTGAGCAG GGTTGAGCCG AGCATAGCCG TGCATAGCAA
TAGATAGCGT GATATAGCGG ATTATAGCAC GGACTAGCTA

GCCCTAGCGT AGGCTAGCTG TGAGTAGCAT CTAGTAGCCG

TTCGTAGCAC GGGGTAGCCT AGTGTAGCAA TGTGTAGCCG
CTTGTAGCAT AAATTAGCTC CACTTAGCTA ACGTTAGCAC
AAAAACGCTG GCAAACGCAA GAGAACGCTA ACGAACGCAG
TCGAACGCCA TGACACGCGT GACCACGCCA TCCCACGCTA
TTCCACGCGC AGTCACGCGA CTTCACGCGT GCCGACGCAT
CGATACGCCA ATATACGCCT AGCTACGCCC GATTACGCGC
ATTTACGCAG TTTTACGCCA GAAACCGCCC TCAACCGCTC
TTAACCGCGA TAGACCGCAC CGTACCGCGA ATTACCGCGT

CAACCCGCTG GCCCCCGCAC CCGCCCGCAG TGAGCCGCGC

TTCGCCGCGT CCTGCCGCTA CTTGCCGCGC GGCTCCGCTG
ACGTCCGCGT CGGTCCGCTC ACCAGCGCAT AAACGCGCCT
AATCGCGCAG TATCGCGCCA GCTCGCGCTA GTTCGCGCGC

GAAGGCGCTG ACAGGCGCAA TCAGGCGCCG CCCGGCGCAC

AAGGGCGCTA GCGGGCGCAG TCTGGCGCAT TACTGCGCGC

GTCTGCGCCA CATTGCGCGT CGAATCGCAG TTAATCGCCT

TGCATCGCCC GTGATCGCAT CGTATCGCCT ATTATCGCCA

TTTATCGCAG TGGCTCGCTC GACGTCGCGC ATCGTCGCAG

TTCGTCGCCA CAGGTCGCGG AGTGTCGCCC TAATTCGCTG

GCATTCGCCG ACGTTCGCCA TCGTTCGCAG GCTTTCGCAT

TTGAAGGCTG GTTAAGGCTT CTACAGGCAC CGCCAGGCAT

ATCCAGGCAA TTCCAGGCCG CAGCAGGCGA TGTCAGGCAC

GAATAGGCAT AGCTAGGCGG TAGTAGGCCT GCGTAGGCTT

GATTAGGCCG TCTTAGGCTG GAAACGGCGG ATAACGGCAC

AGCACGGCAT CTCACGGCAA AAGACGGCGA GGTCCGGCTA

AGAGCGGCAA TGAGCGGCCG CTAGCGGCAT CGCGCGGCAC

GGGGCGGCAG TGTGCGGCAT CTTGCGGCCG AATTCGGCTC

TGAAGGGCTC TTCAGGGCTT CCTAGGGCGA CTTAGGGCTC

GTACGGGCAT GGCCGGGCAC CGGCGGGCAG TTGCGGGCCT

GTTCGGGCCG TCAGGGGCGC TTAGGGGCTA CGTGGGGCTA

ATTGGGGCTT CAATGGGCAC AACTGGGCAA TACTGGGCCG

GCCTGGGCTG CCGTGGGCTC AGGTGGGCGT CTGTGGGCGA

TGCATGGCGG AAGATGGCCT GATATGGCAA ACTATGGCTG

AACCTGGCTT GACGTGGCCG TCCGTGGCTG CAGGTGGCCC

AGTGTGGCGG GCATTGGCGC GTATTGGCTA ATGTTGGCTG

TTGAATGCGT AATAATGCAC GTTAATGCGG CCTCATGCCA

CAAGATGCCG TACGATGCAC CATGATGCAT ACATATGCGA

ATATATGCTC CCCTATGCGC AGCTATGCTT CTCTATGCTA

-continued

GCGTATGCGG TCTTATGCGT GAAACTGCTT TCAACTGCCT

GCGACTGCAT ACTACTGCCA TCTACTGCAG TACCCTGCAT

TGGCCTGCGA CATCCTGCAC GACGCTGCTA ACCGCTGCAG

TCCGCTGCCA GTATCTGCCG CGGTCTGCCT ATGTCTGCCA

TTGTCTGCAG GTTTCTGCAT TTCAGTGCGG CAGAGTGCCA

AAACGTGCTC CACCGTGCTA ACGCGTGCAC GATGGTGCAC

ATTGGTGCGG GGATGTGCTA GCCTGTGCGT AGGTGTGCTG

TCAATTGCGA TTAATTGCTC TGCATTGCTT ACTATTGCGT

CGTATTGCTC GGACTTGCAT AACCTTGCGG GTCCTTGCAC

TGGCTTGCCT CTGCTTGCAG GGTCTTGCCG TGAGTTGCTA

TCCGTTGCGT CCTGTTGCGC AGTGTTGCTT CTTGTTGCTA

CACTTTGCAT CGGTTTGCGA ATGTTTGCGT TATTTTGCAC

GAAAAATCGC ATAAAATCAG TTAAAATCCA GTGAAATCAA

CGTAAATCCA ATTAAATCCT TGAGAATCCC CGCGAATCAG

TTCGAATCCT GGGGAATCAC CTTGAATCCC ACGTAATCCT

AATTAATCTG GCTTAATCAA TCGACATCGA TTGACATCTC

TGACCATCCT CTACCATCAG GACCCATCGA TTCCCATCCC

GGGCCATCAT AGTCCATCCA TGTCCATCAG CTTCCATCCT

TGGGCATCTA CGATCATCGA ATATCATCGT CCCTCATCTT

AGCTCATCGC GATTCATCCC TCTTCATCTC TTTTCATCGA

CAAAGATCGT AGGAGATCAC ATTCGATCTG AAAGGATCGC

GTAGGATCAG CACGGATCGA CGGGGATCAT ATGGGATCAA

TTGGGATCCG GTTGGATCCT ACCTGATCCG TCCTGATCAA

GCAATATCAT GAGATATCTT TCGATATCCT TATATATCTG

GCTATATCCG TGACTATCGA GACCTATCCT TCCCTATCTT

CCTCTATCTC AGTCTATCGT CTTCTATCGA AACGTATCTG

GCCGTATCAA CGATTATCCT ATATTATCCA TTATTATCAG

CTCTTATCCC GTGTTATCCG CGTTTATCAG TTTTTATCCT

TTAAACTCAC TGCAACTCAT CTCAACTCCG TAGAACTCGA

GTGAACTCCC CGTAACTCAC GGACACTCTT GCCCACTCGA

GTCCACTCTC CTGCACTCTG AGAGACTCCG TGAGACTCAA

GGGGACTCCA AGTGACTCAT CTTGACTCAA CACTACTCTT

TATTACTCTC GCTTACTCCC GCAACCTCGC GTAACCTCTA

ATGACCTCTG ATCCCCTCCG TTCCCCTCAA AGTCCCTCAC

GGAGCCTCTC GTCGCCTCTT TGCTCCTCGG AAGTCCTCCT

GATTCCTCAA ACTTCCTCTG GGAAGCTCCG AGGAGCTCCA

TGGAGCTCAG CTGAGCTCCT GGTAGCTCAT ACACGCTCGT

CGACGCTCTC AGCCGCTCTA CTCCGCTCTT TCTCGCTCGA

TTTCGCTCTC TAAGGCTCGG ATGGGCTCCC CCATGCTCAG

GACTGCTCTC TCCTGCTCCC CAGTGCTCTG CCTTGCTCCT

-continued

AATATCTCTC CGCCTCTCGG GGGCTCTCGC TACGTCTCTC
GCCGTCTCCC CCGGTCTCCG CATGTCTCTT GAATTCTCGG
ATATTCTCAC AGCTTCTCAT CTCTTCTCAA AAGTTCTCGA
ACAAAGTCTC CGAAAGTCGT ATAAAGTCGA CCCAAGTCTA
CTCAAGTCGC AAGAAGTCAC GTGAAGTCGG TTTAAGTCGT
CCGCAGTCCA CCAGAGTCTT AGAGAGTCGC CGCGAGTCGA
ATCGAGTCGT CAGGAGTCAT TCGTAGTCGT GCTTAGTCGG
TAAACGTCTG GCAACGTCCG ACGACGTCCA TCGACGTCAG
GCTACGTCAT CCACCGTCTC AGACCGTCGT CTACCGTCGA
GACCCGTCAG ACCCCGTCTA ATCCCGTCGC CAGCCGTCAC
TGTCCGTCGA CGATCGTCAG TTATCGTCCT TGCTCGTCCC
GTGTCGTCAT CGTTCGTCCT ATTTCGTCCA TTTTCGTCAG
GGAAGGTCGC GTCAGGTCGT CATAGGTCCA ACTCGGTCAC
TAAGGGTCCC GCAGGGTCTC GTAGGGTCGA CACGGGTCAG
GAGGGGTCAC ATGGGGTCGG TCCTGGTCGG AGTTGGTCTG
GGCATGTCTG ACGATGTCGT CGGATGTCTC AGACTGTCCA
TGACTGTCAG CTACTGTCCT CGCCTGTCCC GGGCTGTCCG
TGTCTGTCCT CTTCTGTCAG GCCGTGTCGG CCGGTGTCGC
AGGGTGTCTT CTGGTGTCTA GAATTGTCCC TCATTGTCTC
TTATTGTCGA TAGTTGTCAC CGTTTGTCGA ATTTTGTCGT
CGAAATTCTG GTGAATTCTT TTTAATTCTG GGACATTCCC
GTCCATTCCT TGGCATTCAC CATCATTCGA CCAGATTCGG
ATCGATTCTG AAATATTCCA TAATATTCAG CACTATTCCC
GAGTATTCCG TCGTATTCTG TATTATTCCT GCTTATTCTT
TAAACTTCGT GGCACTTCCA AATACTTCGA AGACCTTCTG
GGGCCTTCTA GGAGCTTCCT TACGCTTCGA GTCGCTTCCC
TGGGCTTCAT CTGGCTTCCG GGTGCTTCAG ACATCTTCAC
CCCTCTTCAA AAGTCTTCTC GTCAGTTCTG CCGAGTTCGA
CTGAGTTCTC CGACGTTCCT ATACGTTCCA TTACGTTCAG
CTCCGTTCCC GTGCGTTCCG CGTCGTTCAG TTTCGTTCCT
CGGGGTTCTA ATGGGTTCTT TGATGTTCGA GACTGTTCCT
TCCTGTTCTT CCTTGTTCTC AGTTGTTCGT CTTTGTTCGA
AAAATTTCAG TAAATTTCCA GCAATTTCTA GTAATTTCGC
GGCATTTCGT GAGATTTCAA ACGATTTCTG AATATTTCCT
ACCCTTTCCG TCCCTTTCAA GGAGTTTCGA TACGTTTCCT
GCCGTTTCTT AGGGTTTCGG CATGTTTCCC ATTTTTTCTG
TGAAAAAGGA GACAAAAGCT TCCAAAAGTT CCTAAAAGTC
AGTAAAAGGT CTTAAAAGGA GCACAAAGAT GAGCAAAGTT
TCGCAAAGCT TATCAAAGTG GCTCAAAGCG GAAGAAAGCA
TCAGAAAGTA TTAGAAAGGC TGCGAAAGGT AAGGAAAGCG
TAGGAAAGAA ACTGAAAGTT CGTGAAAGGC GTCTAAAGTG

-continued

CCGTAAAGGA CTGTAAAGTC TTACCAAGGT TGCCCAAGGC
ACTCCAAGTC CGTCCAAGGT ATTCCAAGGA GCAGCAAGAC
CACGCAAGTG GAGGCAAGTC TCGGCAAGCC AGATCAAGCT
CTATCAAGCA ATCTCAAGCC AGTTCAAGAG TGTTCAAGCA
AAAAGAAGCA TAAAGAAGAG CACAGAAGCC GAGAGAAGCG
TCGAGAAGTG TATAGAAGCT GCTAGAAGTT CCACGAAGAC
GACCGAAGTG ACCCGAAGAA TCCCGAAGCG CAGCGAAGTC
AACGGAAGCT TGGGGAAGGG GGTGGAAGGT CGATGAAGTG
GTGTGAAGTT TTTTGAAGTG GAACTAAGGC ATACTAAGAG
TTACTAAGCA GTGCTAAGAA CGTCTAAGCA ATTCTAAGCT
TTGGTAAGTT GTTGTAAGTG AGATTAAGGA CTATTAAGGT
ACCTTAAGTT CGCTTAAGGC GGGTTAAGGG TGTTTAAGGT
CGCAACAGGG GGGAACAGGC AATCACAGTC GAAGACAGAC
ATAGACAGGG CCCGACAGTG TAGGACAGCC GCGGACAGTC
GTGGACAGGA GGTTACAGTA TACACCAGTT GCCACCAGCT
CATACCAGTC GAACCCAGAT AGCCCCAGGG TAGCCCAGCT
GCGCCCAGTT GATCCCAGCG TCTCCCAGTG TAAGCCAGTA
GCAGCCAGCA ACGGCCAGCG TCGGCCAGAA AATGCCAGTT
CTATCCAGAC CGCTCCAGAT ATCTCCAGAA TTCTCCAGCG
CAGTCCAGGA TGTTCCAGAC AAAAGCAGAC GTAAGCAGGG
CACAGCAGAA ACGAGCAGTC CGGAGCAGGT ATGAGCAGGA
CCACGCAGCA ACCCGCAGCC CAAGGCAGAT CCGGGCAGTT
AGGGGCAGGC CATGGCAGCG TCATGCAGGT TGCTGCAGTA
ACTTGCAGGA ATTTGCAGTC GGAATCAGTT GCCATCAGGA
GTCATCAGTC CTGATCAGTG TTACTCAGAC TGCCTCAGAT
CTCCTCAGCG TAGCTCAGGA GTGCTCAGCC CGTCTCAGAC
GCAGTCAGGT GGCGTCAGTA CAGTTCAGCT CCTTTCAGTG
AGAAAGAGCA TGAAAGAGAG CTAAAGAGCT CGCAAGAGCC
GGGAAGAGCG TGTAAGAGCT CTTAAGAGAG GGCCAGAGTG
ACGCAGAGGT CGGCAGAGTC ATAGAGAGCC AGCGAGAGCT
CTCGAGAGCA TAGGAGAGGG GATGAGAGGT CAATAGAGTG
GCCTAGAGAC CCGTAGAGAG CCGACGAGGT AGGACGAGTC
CGACCGAGCA ATACCGAGCT AGCCCGAGCC GATCCGAGGC
ATTCCGAGAG TTTCCGAGCA GTAGCGAGTG ACGGCGAGGC
CGGGCGAGTT ATGGCGAGTA TGATCGAGGT GACTCGAGCA
TCCTCGAGTA TTCTCGAGGC AGTTCGAGGA CTTTCGAGGT
TAAAGGAGGA GTAAGGAGCC GGCAGGAGCT TTGAGGAGAC
AATAGGAGGT CTACGGAGTG ACCCGGAGGG GGGCGGAGTT
TGTCGGAGTG GGAGGGAGCA TACGGGAGGT AGGGGGAGCG
TGGGGGAGAA CATGGGAGGC CCCTGGAGAT TCTTGGAGAC

-continued

```
CCGATGAGCA ACACTGAGTC CGACTGAGGT ATACTGAGGA
CCCCTGAGTA CTCCTGAGGC AAGCTGAGAC GTGCTGAGGG
TTTCTGAGGT GCTGTGAGAC AGATTGAGAG TGATTGAGCA
GACTTGAGGT GGGTTGAGAA AGTTTGAGCT CTTTTGAGCA
ACCAATAGCG TCCAATAGAA AAACATAGAG TAACATAGCA
GCACATAGTA GTACATAGGC GGCCATAGGT GAGCATAGAA
ACGCATAGTG AATCATAGCT TCAGATAGAT TAGGATAGTT
GCGGATAGCT GATGATAGTG ACTGATAGAA TCTGATAGCG
CAATATAGGT AGGTATAGAC CAAACTAGAG TACACTAGCC
GCCACTAGTC GTCACTAGGA CCGACTAGTG CATACTAGCT
TCACCTAGAC CCCCCTAGCG TAGCCTAGTC GCGCCTAGCC
GTAGCTAGGT GGCGCTAGGC CGGGCTAGGG AATGCTAGCC
TGATCTAGTG CTTTCTAGTG ACGAGTAGCT AATAGTAGTG
GCTAGTAGAA AGACGTAGGA CTACGTAGGT ACCCGTAGTT
CGCCGTAGGC GGGCGTAGGG TGTCGTAGGT TACGGTAGTG
GCCGGTAGCG CCGGGTAGCC GAATGTAGGC ATATGTAGAG
TTATGTAGCA GTGTGTAGAA CGTTGTAGCA ATTTGTAGCT
GGAATTAGCC GTCATTAGCT TGGATTAGAC CATATTAGGA
CGACTTAGTG GTGCTTAGTT TTTCTTAGTG TAAGTTAGGC
GTAGTTAGCA ATGGTTAGCG TTGGTTAGAA CCATTTAGAC
GACTTTAGTG ACCTTTAGAA TCCTTTAGCG CAGTTTAGTC
CGAAAACGGG GTGAAACGGT TTTAAACGGG CATCAACGTA
CCAGAACGTG GACGAACGAC ATCGAACGGG CAGGAACGAG
TCGTAACGGG GCTTAACGGT TAAACACGTT GCAACACGCT
TCGACACGAT AATACACGTA GCTACACGAG AGACCACGGG
GACCCACGAT GGGCCACGGA TACGCACGTA GCCGCACGCA
CGATCACGAT ATATCACGAA TTATCACGCG CTCTCACGAC
AAGTCACGGC GTGTCACGAG CGTTCACGCG TTTTCACGAT
CAAAGACGAA AACAGACGAC GTCAGACGGG CCGAGACGTA
CTGAGACGGC ACACGACGCC CCCCGACGCA CACGGACGAT
CGGGGACGGA ATGGGACGGT TATGGACGAC TGATGACGTA
TCCTGACGGT CCTTGACGGC AGTTGACGTT CTTTGACGTA
GCAATACGGA GTAATACGTC GGCATACGTT ACGATACGGG
TGACTACGAT CTACTACGCG TTCCTACGAC GGGCTACGCT
AGTCTACGAA TGTCTACGCG CTTCTACGAT GGAGTACGTA
GCCGTACGGT AGGGTACGTG GATTTACGAC ATTTTACGGG
GAAAACCGCT TCAAACCGTT TGCAACCGGA TAGAACCGAT
GATAACCGAG ACTAACCGTA ATTAACCGGC GCCCACCGAT
TGAGACCGGT GACGACCGCA TCCGACCGTA TTCGACCGGC
AGTGACCGGA CTTGACCGGT GTATACCGTG ACGTACCGGC
CGGTACCGTT ATGTACCGTA TGACCCCGGC TTCCCCCGGT
```

-continued

```
CCTCCCCGTA CTTCCCCGGC CAAGCCCGTG GCCGCCCGAC
CCGGCCCGAG ATATCCCGCC AGCTCCCGCT CTCTCCCGCA
TAGTCCCGGG GATTCCCGGT CAAAGCCGCC AACAGCCGCA
TACAGCCGAG GGTAGCCGGA GAACGCCGTG ACACGCCGAA
TCACGCCGCG CCCCGCCGAC AAGCGCCGTA GCGCGCCGAG
TCTCGCCGAT AAAGGCCGCT AATGGCCGAG TATGGCCGCA
GCTGGCCGTA GTTGGCCGGC CGCTGCCGTG GGGTGCCGTC
TCGATCCGGC TTGATCCGTA GACCTCCGGC ATCCTCCGAG
TTCCTCCGCA CAGCTCCGGG AGTCTCCGCC TGGGTCCGTC
ACATTCCGTT CGATTCCGGC AGCTTCCGGA CTCTTCCGGT
AAGTTCCGAT GATTTCCGCA TCTTTCCGTA TTTTTCCGGC
CGAAAGCGAA ATAAAGCGAT AGCAAGCGAC ATTAAGCGCG
TTTAAGCGAA CTAGAGCGAC CGCGAGCGAT ATCGAGCGAA
TTCGAGCGCG CAGGAGCGGA TGTGAGCGAC TAATAGCGTA
GCATAGCGCA ACGTAGCGCG TCGTAGCGAA AATTAGCGTT
GCTACGCGGA GTTACGCGTC AGACCGCGAA TGACCGCGCG
CTACCGCGAT CGCCCGCGAC GGGCCGCGAG TGTCCGCGAT
CTTCCGCGCG GGTGCGCGTA GAATCGCGAC ATATCGCGGG
CCCTCGCGTG TAGTCGCGCC GCGTCGCGTC GTGTCGCGGA
CAAAGGCGGG GTCAGGCGAA TCACGGCGGC TTACGGCGTA
CGTCGGCGTA ATTCGGCGTT GTAGGGCGAT GGCGGGCGAC
CGGGGGCGAG TTGGGGCGCT GTTGGGCGCG ACCTGGCGCT
AAAATGCGTA GCAATGCGAG CACATGCGTC GAGATGCGTG
ACGATGCGAA TCGATGCGCG TATATGCGTT GCTATGCGCT
GACCTGCGCG TCCCTGCGTG CAGCTGCGCC AGTCTGCGGG
AACGTGCGTT CGATTGCGCG TTATTGCGAT TGCTTGCGAC
GTGTTGCGCT CGTTTGCGAT ATTTTGCGAA TTTTTGCGCG
GAAAATCGTC TCAAATCGCC CCCAATCGAG GCGAATCGAC
CAACATCGCG TACCATCGAC CATCATCGAT CCTGATCGCA
GGCTATCGCG CGGTATCGCC AATTATCGGG GTTTATCGAC
AAAACTCGCG TAAACTCGAA GAGACTCGCA TCGACTCGTA
TTGACTCGGC AATACTCGAT GACCCTCGTA ACCCCTCGAG
TCCCCTCGCA TACGCTCGAT TGGGCTCGGA CATGCTCGAC
CGATCTCGTA ATATCTCGTT CCCTCTCGGT AGCTCTCGTC
TCTTCTCGGC TTTTCTCGTA CAAAGTCGTT CCGAGTCGAT
GATCGTCGAC ATTCGTCGGG AAAGGTCGTC CACGGTCGTA
ACGGGTCGAC TGATGTCGAT CTATGTCGCG TTCTGTCGAC
GGGTGTCGCT AGTTGTCGAA TGTTGTCGCG CTTTGTCGAT
GGCATTCGAA GAGATTCGGT TATATTCGGG TGACTTCGTA
TCCCTTCGGT CCTCTTCGGC AGTCTTCGTT CTTCTTCGTA
```

-continued

```
GGAGTTCGAT AACGTTCGGG GTCGTTCGAC TGGGTTCGCT
CTGGTTCGAG GGTGTTCGCG ACATTTCGCC CCCTTTCGCA
GGAAAAGGCG AGGAAAGGCA TGGAAAGGAG CTGAAAGGCT
GGTAAAGGAT ACACAAGGGT CGACAAGGTC AGCCAAGGTA
CTCCAAGGTT TCTCAAGGGA TTTCAAGGTC TAAGAAGGGG
ATGGAAGGCC CCATAAGGAG GACTAAGGTC TCCTAAGGCC
CAGTAAGGTG CCTTAAGGCT CCAACAGGGT AGAACAGGTC
CGCACAGGTA ATCACAGGTT CGGCCAGGCA ATGCCAGGCT
GTTCCAGGAA ACAGCAGGGC CGAGCAGGTT ATAGCAGGTA
CCCGCAGGGA CTCGCAGGTC GTGGCAGGTG TTTGCAGGTT
AACTCAGGCG TACTCAGGAA TGGTCAGGGT GGTTCAGGGG
TTAAGAGGAC TGCAGAGGAT CTCAGAGGCG TAGAGAGGGA
GTGAGAGGCC CGTAGAGGAC GGACGAGGTT GCCCGAGGGA
GTCCGAGGTC CTGCGAGGTG AGAGGAGGCG TGAGGAGGAA
GGGGGAGGCA AGTGGAGGAT CTTGGAGGAA CACTGAGGTT
TATTGAGGTC GCTTGAGGCC CCAATAGGCA ACCATAGGCC
AAACTAGGAC GTACTAGGGG CACCTAGGAA ACGCTAGGTC
CGGCTAGGGT ATGCTAGGGA CCCGTAGGCT GATGTAGGTC
TCTGTAGGCC GGATTAGGAA AGGTTAGGAG TGGTTAGGCA
CAAAACGGGT AGGAACGGAC ATTCACGGTG AAAGACGGGC
GTAGACGGAG CACGACGGGA CGGGACGGAT ATGGACGGAA
TTGGACGGCG GTTGACGGCT ACCTACGGCG TCCTACGGAA
TGAACCGGTG CTTACCGGTG AAACCCGGGT GGCCCCGGAG
CGGCCCGGAC TATCCCGGGA GTTCCCGGCC TCAGCCGGGG
CAATCCGGAG TACTCCGGCC GCCTCCGGTC GTCTCCGGGA
CCGTCCGGTG CATTCCGGCT GAAAGCGGGC ATAAGCGGAG
TTAAGCGGCA GTGAGCGGAA CGTAGCGGCA ATTAGCGGCT
TGAGGCGGCC CGCGGCGGAG TTCGGCGGCT GGGGGCGGAC
CTTGGCGGCC ACGTGCGGCT AATTGCGGTG GCTTGCGGAA
CCAATCGGAC GACATCGGTG ACCATCGGAA TCCATCGGCG
CAGATCGGTC AAACTCGGCA TAACTCGGAG CACCTCGGCC
GAGCTCGGCG TCGCTCGGTG TATCTCGGCT GCTCTCGGTT
ACAGTCGGAT AAGGTCGGTT ACTGTCGGCG TCTGTCGGAA
GGATTCGGCC GTCTTCGGCT TGGTTCGGAC CATTTCGGGA
TACAAGGGAT TGGAAGGGGA CATAAGGGAC GAACAGGGTT
TCACAGGGCT GCGCAGGGAT ACTCAGGGCA TCTCAGGGAG
AAAGAGGGCG TAAGAGGGAA GAGGAGGGCA TCGGAGGGTA
TTGGAGGGGC AATGAGGGAT CCATAGGGGA CTATAGGGTC
ACCTAGGGGC CGCTAGGGTT ATCTAGGGTA TGTTAGGGTC
CCTACGGGCA TTGCCGGGGT AATCCGGAC GTTCCGGGGG
GAAGCGGGTC TCAGCGGGCC CCCGCGGGAG GCGGCGGGAC
TACTCGGGGG AGGTCGGGCT CTGTCGGGCA GGTTCGGGAA
GAAAGGGGCG TCAAGGGGTG AAGAGGGGCA TAGAGGGGAG
GATAGGGGAT CAACGGGGTC AACCGGGGTA GCCCGGGGAG
CCGCGGGGAC TGAGGGGGGG CTTGGGGGGG GTATGGGGTT
GGCTGGGGTC CGGTGGGGTG TCCATGGGGC TTCATGGGTA
CCTATGGGGT AGTATGGGGT GTACTGGGAA CACCTGGGGG
GAGCTGGGGC ATGCTGGGAG TTGCTGGGCA TTAGTGGGTT
TGCGTGGGTC ACTGTGGGCG CGTGTGGGTT ATTGTGGGTA
GGATTGGGGG AACTTGGGAT AGGTTGGGGA CTGTTGGGGT
GGTAATGGTA GAACATGGGA TACATGGAC AGCCATGGAT
CTCCATGGAA AAGCATGGGA GCTGATGGGA GTTGATGGTC
CGCTATGGGG GGGTATGGGC CTAACTGGAC CGCACTGGAT
ATCACTGGAA TTCACTGGCG CAGACTGGGA TGTACTGGAC
TTGCCTGGTG GTTCCTGGTT CGAGCTGGAA ATAGCTGGAT
AGCGCTGGAC ATTGCTGGCG TTTGCTGGAA TACTCTGGTT
GCCTCTGGCT CATTCTGGTC TCAAGTGGGT TGCAGTGGTA
ACTAGTGGGA ATTAGTGGTC GGACGTGGAA AGGCGTGGAG
TGGCGTGGCA TGAGGTGGTT TCCGGTGGGA TTCGGTGGTC
AGTGGTGGTA CTTGGTGGTT AAATGTGGAC GTATGTGGGG
CACTGTGGAA ACGTGTGGTC CGGTGTGGGT ATGTGTGGGA
CAGATTGGCT CCTATTGGTG CACCTTGGTT TATCTTGGTC
GCTCTTGGCC TTAGTTGGGG AAGGTTGGCC CGTGTTGGGG
GGATTTGGTT GCCTTTGGGA GTCTTTGGTC CTGTTTGGTG
ACCAAATGAT AAACAATGCT AATCAATGAG TATCAATGCA
GCTCAATGTA GTTCAATGGC GAAGAATGTG ACAGAATGAA
TCAGAATGCG CCCGAATGAC AAGGAATGTA GCGGAATGAG
TCTGAATGAT TACTAATGGC GTCTAATGCA CATTAATGGT
CAAACATGCT CATACATGAG CCCCCATGAT TCTCCATGAC
AAAGCATGCC CACGCATGCA TTGGCATGGG GTTGCATGGT
CTATCATGTG ACCTCATGGG GGGTCATGTT TGTTCATGTG
AAAAGATGTG GCAAGATGAA GAGAGATGTA ACGAGATGAG
TCGAGATGCA TGACGATGGT GACCGATGCA TCCCGATGTA
TTCCGATGGC AGTCGATGGA CTTCGATGGT GCCGGATGAT
CGATGATGCA ATATGATGCT AGCTGATGCC GATTGATGGC
ATTTGATGAG TTTTGATGCA CAAATATGGA AACATATGGC
GTCATATGAG CTGATATGAC GGTATATGCC TTACTATGTG
CGTCTATGTG CACGTATGGT CGGGTATGAA ATGGTATGAT
TATGTATGGC GTTGTATGCA TCCTTATGAT CCTTTATGAC
CCAAACTGCT CCTAACTGAG CACCACTGAT CGGCACTGGA
ATGCACTGGT TATCACTGAC ACAGACTGCC CCCGACTGCA
```

-continued

```
GGATACTGAT AACTACTGGG GTCTACTGAC TGGTACTGCT
CTGTACTGAG GGTTACTGCG GGAACCTGGG AACACCTGAT
AGGACCTGGA CTGACCTGGT ACACCCTGCT GATCCCTGTA
ACTCCCTGAG TCTCCCTGCA AAAGCCTGAA TAAGCCTGCG
GCAGCCTGTG CACGCCTGAC GAGGCCTGAG ACGGCCTGTA
ATGGCCTGGC TATGCCTGAT TCCTCCTGGC TTCTCCTGTA
CCTTCCTGGT AGTTCCTGTC TAAAGCTGTC GCAAGCTGCC
TCGAGCTGAC CCACGCTGTG GACCGCTGAC ATCCGCTGGG
CAGCGCTGAG CATGGCTGTA CGATGCTGAC AGCTGCTGAA
TGCTGCTGCG CTCTGCTGAT AAGTGCTGGT TTTTGCTGAC
TACATCTGGG AGGATCTGCT CTGATCTGCA GGTATCTGAA
ACACTCTGGA ATACTCTGTC CCCCTCTGGC AGCCTCTGTT
CTCCTCTGTA GCGCTCTGGG TCTCTCTGGT GGCGTCTGCG
CGGGTCTGCC AATGTCTGGG GTTGTCTGAC CCTTTCTGCA
AGAAAGTGTG GGGAAGTGTA TAACAGTGGT GGCCAGTGCA
AATCAGTGGA ACAGAGTGGG CTCGAGTGTG GCGGAGTGGA
GTGGAGTGTC CAATAGTGCA AACTAGTGCC GGTTAGTGGC
GGAACGTGCC GTCACGTGCT TGGACGTGAC CATACGTGGA
CGACCGTGTG GTGCCGTGTT TTTCCGTGTG TAAGCGTGGC
GTAGCGTGCA ATGGCGTGCG TTGGCGTGAA CCATCGTGAC
GACTCGTGTG ACCTCGTGAA TCCTCGTGCG CAGTCGTGTC
GCAAGGTGGG ACGAGGTGGA ATGAGGTGTC AGACGGTGCT
CTACGGTGCA ATCCGGTGCC AGTCGGTGAG TGTCGGTGCA
GGAGGGTGTG AGGGGGTGTA CTGGGGTGTT TTATGGTGGT
TGCTGGTGGC ACTTGGTGTC CGTTGGTGGT ATTTGGTGGA
CAAATGTGAG TACATGTGCC GCCATGTGTC GTCATGTGGA
CCGATGTGTG CATATGTGCT TCACTGTGAC CCCCTGTGCG
TAGCTGTGTC GCGCTGTGCC GTAGTGTGGT GGCGTGTGGC
CGGGTGTGGG AATGTGTGCC TGATTGTGTG CTTTTGTGTG
CCAAATTGTC AGAAATTGGT CTAAATTGGA GACAATTGAG
ACCAATTGTA ATCAATTGGC CAGAATTGAC TGTAATTGGA
TAACATTGTG GCACATTGCG ACGCATTGCA TCGCATTGAG
GCTCATTGAT ACAGATTGTT CGAGATTGGC AGCGATTGGA
CTCGATTGGT AAGGATTGAT GATGATTGCA TCTGATTGTA
TTTGATTGGC TGGTATTGTC CCGACTTGCA ACACCTTGTC
CGACCTTGGT ATACCTTGGA CCCCCTTGTA CTCCCTTGGC
AAGCCTTGAC GTGCCTTGGG TTTCCTTGGT GCTGCTTGAC
AGATCTTGAG TGATCTTGCA GACTCTTGGT GGGTCTTGAA
AGTTCTTGCT CTTTCTTGCA TAAAGTTGCT GCAAGTTGTT
GGCAGTTGGA GAGAGTTGAT AATAGTTGCA TATAGTTGAG
TCCCGTTGAT CCTCGTTGAC GGAGGTTGGT AACGGTTGAG
TACGGTTGCA GCCGGTTGTA GTCGGTTGGC CTGGGTTGGG
TTATGTTGTG CGTTGTTGTG CCGATTTGGT AGGATTTGTC
CGACTTTGCA ATACTTTGCT AGCCTTTGCC GATCTTTGGC
ATTCTTTGAG TTTCTTTGCA GTAGTTTGTG ACGGTTTGGC
CGGGTTTGTT ATGGTTTGTA TGATTTTGGT GACTTTTGCA
TCCTTTTGTA TTCTTTTGGC AGTTTTTGGA CTTTTTTGGT
GATAAAATAC ATTAAAATGG CAACAAATTT CCGCAAATAT
TTCGAAATGG CAGGAAATCA GCATAAATGA GTATAAATTC
GGCTAAATTT ACGTAAATGG AAAACAATTT ACGACAATAT
TATACAATTA GCTACAATCA TGACCAATGG CTTCCAATGG
CAAGCAATTC AACGCAATTA GCCGCAATAG CCGGCAATAC
ATATCAATCG TTATCAATAA TAGTCAATGC GTGTCAATCA
CGTTCAATAA ATTTCAATAT CAAAGAATCG TACAGAATAC
CATAGAATAT GAACGAATTC TCACGAATCC CCCCGAATAG
GCGCGAATAC TTGGGAATGT AATGGAATAC GTTGGAATGG
AGATGAATTA CTATGAATTT ACCTGAATGT CGCTGAATTC
GGGTGAATTG TGTTGAATTT TCGATAATGG GCTATAATGT
AGACTAATAT CTACTAATAA GACCTAATGG ATCCTAATAC
CAGCTAATGC AGTCTAATCG TGTCTAATAA TGGGTAATTG
GGTGTAATTT CGATTAATGG GTGTTAATGT TTTTTAATGG
ACAAACATTT CGAAACATGC AGCAACATGA CTCAACATGT
AAGAACATAT GATAACATCA TCTAACATTA TTTAACATGC
CCAGACATTC AGAGACATGT CTAGACATGA GACGACATAG
ACCGACATTA ATCGACATGC CAGGACATAC TGTGACATGA
TCGTACATGC TTGTACATTA GCTACCATAC CCACCCATTT
AGACCCATGC CGCCCCATGA ATCCCCATGT CAGCCCATAT
CCGGCCATCA GAATCCATGA TTATCCATCC TGCTCCATCT
CTCTCCATAG AAGTCCATGG GTGTCCATAC CGTTCCATCC
GGAAGCATGT AACAGCATAG TACAGCATCA GCCAGCATTA
GTCAGCATGC CTGAGCATGG ACACGCATCG TCACGCATAA
TAGCGCATTA GCGCGCATCA ACTCGCATAT TAAGGCATCT
GCAGGCATTT GGCGGCATGA GAGGGCATAT AATGGCATCA
TATGGCATAG CCTTGCATGG GTAATCATTG ACGATCATGC
CGGATCATTT ATGATCATTA CTACTCATCC CGCCTCATCT
ATCCTCATCA TTCCTCATAG TGTCTCATCC CCGGTCATGT
AGGGTCATTC GAATTCATCT TCATTCATTT TGCTTCATGA
TAGTTCATAT GATTTCATAG ACTTTCATTA ATTTTCATGC
CGAAAGATCG TTAAAGATAT TGCAAGATAC GTGAAGATCT
CGTAAGATAT ATTAAGATAA TTTAAGATCG GGACAGATTC
GTCCAGATTT ATCGAGATCG TTCGAGATAA AGTGAGATAC
```

-continued

AAATAGATTA GCATAGATAG CACTAGATTC GAGTAGATTG
ACGTAGATAA TCGTAGATCG TATTAGATTT GCTTAGATCT
GCAACGATGT GGCACGATTA AGACCGATCG TGACCGATAA
GGGCCGATCA AGTCCGATAT CTTCCGATAA GGAGCGATTT
GCCGCGATGA GTCGCGATTC CTGGCGATTG TTATCGATGG

AAGTCGATCC CGTTCGATGG GTCAGGATCG CTGAGGATCC

GGTAGGATAC ACACGGATGC CGACGGATTT ATACGGATTA
CCCCGGATGA CTCCGGATTC GTGCGGATTG TTTCGGATTT
CGGGGGATCA ATGGGGATCT GTTGGGATAA GACTGGATTT
TCCTGGATCT CCTTGGATCC TAAATGATTA GCAATGATCA
ACGATGATCG TCGATGATAA AATATGATTT CTACTGATGG
GACCTGATAA ACCCTGATTG GGGCTGATGT TGTCTGATGG
TACGTGATTT GCCGTGATCT CATGTGATTC CGATTGATAA
ATATTGATAT AGCTTGATAC ATTTTGATCG TTTTTGATAA
ACAAATATCC CCCAATATCA CAACATATAA AACCATATAC
GTCCATATGG CCGCATATTA CTGCATATGC CCAGATATCT
CCTGATATAG GGCTATATAA GAGTATATGT TATTATATGG
AAAACTATAA TAAACTATCG GCAACTATTG CACACTATAC
GAGACTATAG ACGACTATTA ATGACTATGC TATACTATAT
CCACCTATCC ACCCCTATCA TCCCCTATAG GGAGCTATGG
AACGCTATAT AGGGCTATGA CTGGCTATGT TTATCTATTT
TGCTCTATTC ACTTCTATGC CGTTCTATTT ATTTCTATTA
CATAGTATTA CGACGTATGG GTGCGTATGT TTTCGTATGG
TAAGGTATTC GCAGGTATCC TCGGGTATAC AGATGTATAT
CTATGTATAA GACTGTATGG ATCTGTATAC CAGTGTATGC
AGTTGTATCG TGTTGTATAA GGCATTATCG CGGATTATCC
AATATTATGG GTTATTATAC AGACTTATTA CTACTTATTT
ACCCTTATGT CGCCTTATTC GGGCTTATTG TGTCTTATTT
TACGTTATGG AGGGTTATCT CTGGTTATCA GGTGTTATAA
GAATTTATTC TCATTTATCC CCCTTTATAG GCGTTTATAC
AGAAAACTGA CTAAAACTGT ACCAAACTTT CGCAAACTGC
GGGAAACTGG TGTAAACTGT ACGCAACTCT AATCAACTTG
GCTCAACTAA GAAGAACTAG ACAGAACTTA ATAGAACTGC
CCCGAACTTC AGCGAACTGT CTCGAACTGA AAGGAACTAA
TAGGAACTCG GCGGAACTTG GATGAACTCT TCTGAACTTT
CCGACACTCT CATACACTTG CGACCACTGA ATACCACTGT
CCCCCACTTT AGCCCACTGC GATCCACTCC TCTCCACTTC
TTTCCACTGA ACGGCACTCC TGATCACTCT CTATCACTAG
GACTCACTGA TTCTCACTCC GGGTCACTAT AGTTCACTCA
TGTTCACTAG CTTTCACTCT AAAAGACTAG TAAAGACTCA

GCAAGACTTA GTAAGACTGC GGCAGACTGT GAGAGACTAA

-continued

ACGAGACTTG AATAGACTCT ACCCGACTCG TCCCGACTAA

GGAGGACTGA TACGGACTCT GCCGGACTTT AGGGGACTGG

CATGGACTCC ATTTGACTTG GTCATACTTG CCGATACTGA

CTGATACTTC CGACTACTCT ATACTACTCA TTACTACTAG

CTCCTACTCC GTGCTACTCG CGTCTACTAG TTTCTACTCT

CGGGTACTTA ATGGTACTTT TGATTACTGA GACTTACTCT

TCCTTACTTT CCTTTACTTC AGTTTACTGT CTTTTACTGA

CAGAACCTCT CCTAACCTTG CACCACCTTT TATCACCTTC

GCTCACCTCC TTAGACCTGG AAGGACCTCC CGTGACCTGG

GGATACCTTT GCCTACCTGA GTCTACCTTC CTGTACCTTG

AACACCCTTT TGCCCCCTGG AAGCCCCTCT GATCCCCTAA

ACTCCCCTTG AAAGCCCTTA GCAGCCCTAG CACGCCCTTC

GAGGCCCTTG ACGGCCCTAA TCGGCCCTCG TATGCCCTTT

GCTGCCCTCT ATCTCCCTCG TTCTCCCTAA AGTTCCCTAC

TAAAGCCTAC CACAGCCTCG GAGAGCCTCC TCGAGCCTTC

TTGAGCCTGA CCACGCCTAG GACCGCCTTC TCCCGCCTCC

CAGCGCCTTG CCTCGCCTCT TGGGGCCTGC CATGGCCTAA

ACATGCCTGT CGATGCCTTC AGCTGCCTTA CTCTGCCTTT

TCTTGCCTGA TTTTGCCTTC GGTATCCTTA GAACTCCTGG

ATACTCCTAC AGCCTCCTAT CTCCTCCTAA AAGCTCCTGA

GCTGTCCTGA GTTGTCCTTC CGCTTCCTGG GGGTTCCTGC

AGAAAGCTAG TGAAAGCTCA GACAAGCTGT GGGAAGCTAA

AGTAAGCTCT CTTAAGCTCA TCGCAGCTGT GCTCAGCTGG

GAAGAGCTGA TTAGAGCTCC TGCGAGCTCT CTCGAGCTAG

AAGGAGCTGG GTGGAGCTAC CGTGAGCTCC CCGTAGCTCA

TGGACGCTTC CGACCGCTAG TTACCGCTCT TGCCCGCTCC

GTGCCGCTAT CGTCCGCTCT ATTCCGCTCA TTTCCGCTAG

TCGGCGCTGC TTGGCGCTTA CCATCGCTTC AGATCGCTGT

CTATCGCTGA GACTCGCTAG ACCTCGCTTA ATCTCGCTGC

CAGTCGCTAC TGTTCGCTGA AAAAGGCTGA CACAGGCTGC

GAGAGGCTGG ATGAGGCTAC TATAGGCTGT TCCCGGCTGG

AGTCGGCTTG GGAGGGCTAG AACGGGCTGT AGGGGGCTAA

TGGGGGCTCG CTGGGGCTAT GGTGGGCTCT ACTTGGCTAC

CAAATGCTTG GCCATGCTAC CCGATGCTAG GAACTGCTCC

TCACTGCTTC TTACTGCTGA TAGCTGCTAC CGTCTGCTGA

ATTCTGCTGT AGATTGCTCA TGATTGCTAG CTATTGCTCT

CGCTTGCTCC GGGTTGCTCG TGTTTGCTCT CTTTTGCTAG

CCAAATCTAC GACAATCTTG ACCAATCTAA TCCAATCTCG

CAGAATCTTC AAACATCTCA TAACATCTAG CACCATCTCC

GAGCATCTCG TCGCATCTTG TATCATCTCT GCTCATCTTT

-continued

ACAGATCTAT AAGGATCTTT ACTGATCTCG TCTGATCTAA
GGATATCTCC GTCTATCTCT TGGTATCTAC CATTATCTGA
CAAACTCTCA AACACTCTCC GGTACTCTGC ACACCTCTAC
CCCCCTCTAA AAGCCTCTTC CACGCTCTCT TATGCTCTCC
GCTGCTCTTC GTTGCTCTGA AGATCTCTTG GGGTCTCTTA
GCAAGTCTAT GAGAGTCTTT TCGAGTCTCT TATAGTCTTG
GCTAGTCTCG TGACGTCTGA GACCGTCTCT TCCCGTCTTT
CCTCGTCTTC AGTCGTCTGT CTTCGTCTGA AACGGTCTTG
GCCGGTCTAA CGATGTCTCT ATATGTCTCA TTATGTCTAG
CTCTGTCTCC GTGTGTCTCG CGTTGTCTAG TTTTGTCTCT
CAAATTCTGT AGGATTCTAC ATTCTTCTTG AAAGTTCTGC
GTAGTTCTAG CACGTTCTGA CGGGTTCTAT ATGGTTCTAA
TTGGTTCTCG GTTGTTCTCT ACCTTTCTCG TCCTTTCTAA
GTAAAAGTCT GGCAAAGTCC CGGAAAGTCG TTGAAAGTAT
AATAAAGTGC GTTAAAGTAG CGCCAAGTTG GGGCAAGTTC
TACGAAGTGC GTCGAAGTCA CATGAAGTGT GAATAAGTTG
ACATAAGTAA TCATAAGTCG CCCTAAGTAC AAGTAAGTTA
GCGTAAGTAG TCTTAAGTAT AGCACAGTTG GCGACAGTGT
TCTACAGTGG GGACCAGTCA TACCCAGTGT AGGCCAGTCG
TGGCCAGTAA CATCCAGTGC CTAGCAGTTG ACCGCAGTGG
GGGGCAGTTT TGTGCAGTTG AAATCAGTCC CACTCAGTCA
TTGTCAGTGG GTTTCAGTGT CTAAGAGTCC CGCAGAGTCT
ATCAGAGTCA TTCAGAGTAG TGTAGAGTCC GTACGAGTTG
ACGCGAGTGC CGGCGAGTTT ATGCGAGTTA CGAGGAGTCA
ATAGGAGTCT AGCGGAGTCC GATGGAGTGC ATTGGAGTAG
TTTGGAGTCA GCCTGAGTAT ACAATAGTCG TCAATAGTAA
TAGATAGTTA GCGATAGTCA ACTATAGTAT GGACTAGTGT
AACCTAGTAG TACCTAGTCA GCCCTAGTTA GTCCTAGTGC
CTGCTAGTGG TCCGTAGTAT CCTGTAGTAC CACTTAGTGT
CGGTTAGTAA ATGTTAGTAT TATTTAGTGC GTTTTAGTCA
GGCAACGTAA GAGAACGTGT TATAACGTGG TGACACGTTA
TCCCACGTGT CCTCACGTGC AGTCACGTTT CTTCACGTTA
GGAGACGTAT AACGACGTGG GTCGACGTAC TGGGACGTCT
CTGGACGTAG GGTGACGTCG ACATACGTCC CCCTACGTCA
TTAACCGTTT TGCACCGTTC ACTACCGTGC CGTACCGTTT
ATTACCGTTA GGACCCGTAC GTCCCCGTAT TGGCCCGTCC
TCCGCCGTGC TTCGCCGTTA CCTGCCGTGT AGTGCCGTTC
AAATCCGTAA TAATCCGTCG GCATCCGTTG CACTCCGTAC
GAGTCCGTAG ACGTCCGTTA ATGTCCGTGC TATTCCGTAT
AGAAGCGTAT CTAAGCGTAA GACAGCGTGG ATCAGCGTAC
CAGAGCGTGC AGTAGCGTCG TGTAGCGTAA TCGCGCGTGG

-continued

GCTCGCGTGT CGAGGCGTAC AGCGGCGTAA TGCGGCGTCG
CTCGGCGTAT AAGGGCGTGT TTTGGCGTAC CATTGCGTTA
GAAATCGTTC TCAATCGTCC CCCATCGTAG GCGATCGTAC
CAACTCGTCG TACCTCGTAC CATCTCGTAT CCTGTCGTCA
GGCTTCGTCG CGGTTCGTCC AATTTCGTGG GTTTTCGTAC
CACAAGGTCT TATAAGGTCC GCTAAGGTTC GTTAAGGTGA
CCACAGGTAT CAGCAGGTTT CCTCAGGTCG CAAGAGGTCA
AACGAGGTCC GGTGAGGTGC ACATAGGTGG CTCTAGGTTG
GCGTAGGTGA GTGTAGGTTC ACAACGGTAT AAGACGGTTT
ACTACGGTCG TCTACGGTAA AACCCGGTCT TGGCCGGTGG
GGTCCGGTGT CCAGCGGTAC GACGCGGTTG ACCGCGGTAA
TCCGCGGTCG CAGGCGGTTC TAATCGGTGC GTATCGGTCA
ATGTCGGTCG TTGTCGGTAA GACAGGGTCC TCCAGGGTTC
TTCAGGGTGA CAGAGGGTCG CCTAGGGTTT AGTAGGGTGC
GCACGGGTAC CACCGGGTTG GAGCGGGTTC TCGCGGGTCC
TTAGGGGTGT TGCGGGGTGC ACTGGGGTTC CGTGGGGTGT
ATTGGGGTGA GGATGGGTTG AGGTGGGTTA CTGTGGGTTT
TCAATGGTGG CAACTGGTGC AACCTGGTGA AGGCTGGTAT
CTGCTGGTAA GGTCTGGTCA TGAGTGGTTG CTTGTGGTTG
GTATTGGTGT GGCTTGGTGC CGGTTGGTGG AATTTGGTCC
TCGAATGTGC TTGAATGTTA GACCATGTGC ATCCATGTAG
TTCCATGTCA CAGCATGTGG AGTCATGTCC TGGGATGTTC
ACATATGTTT CGATATGTGC AGCTATGTGA CTCTATGTGT
AAGTATGTAT GATTATGTCA TCTTATGTTA TTTTATGTGC
GAAACTGTGA TTAACTGTCC TGCACTGTCT CTCACTGTAG
AAGACTGTGG GTGACTGTAC CGTACTGTCC TGGCCTGTTT
GGTCCTGTTG AGAGCTGTAG TGAGCTGTCA GACGCTGTGT
GGGGCTGTAA AGTGCTGTCT CTTGCTGTCA GCTTCTGTAC
CCTAGTGTGG CACCGTGTGT CGGCGTGTAA ATGCGTGTAT
TATCGTGTGC GTTCGTGTCA TTAGGTGTTG CGTGGTGTTG
GGATGTGTGT AACTGTGTAG TACTGTGTCA GCCTGTGTTA
GTCTGTGTGC CTGTGTGTGG GAAATTGTCT TCAATTGTTT
TGCATTGTGA TAGATTGTAT GATATTGTAG ACTATTGTTA
ATTATTGTGC GCCCTTGTAT TGAGTTGTGT GACGTTGTCA
TCCGTTGTTA TTCGTTGTGC AGTGTTGTGA CTTGTTGTGT
GTATTTGTTG ACGTTTGTGC CGGTTTGTTT ATGTTTGTTA
ACTAAATTCC TGGCAATTGC CATCAATTAA CCAGAATTAG
GACGAATTTC TCCGAATTCC CAGGAATTTG CCTGAATTCT
TAATAATTGG ATGTAATTCC TAAACATTAT GAGACATTCT
TCGACATTTT AATACATTAA TATACATTCG GCTACATTTG

```
GACCCATTTT TCCCCATTCT CCTCCATTCC AACGCATTCG
TACGCATTAA TGGGCATTGT GGTGCATTGG ACATCATTGC
CGATCATTTT ATATCATTTA CCCTCATTGA CTCTCATTTC
GTGTCATTTG TTTTCATTTT CAAAGATTTA AACAGATTTC
CCGAGATTAA TTACGATTGG AAGCGATTCC CGTCGATTGG
CACGGATTTT TATGGATTTC GCTGGATTCC AGATGATTCG
TGATGATTAA GGGTGATTCA AGTTGATTAT CTTTGATTAA
AAAATATTGG GTAATATTAC GGCATATTAT GAGATATTGA
TTGATATTCC TGACTATTTT TCCCTATTGA TTCCTATTTC
AGTCTATTTA CTTCTATTTT GGAGTATTAA AGGGTATTAG
TGGGTATTCA CCCTTATTCT GATTTATTTC TCTTTATTCC
TCAAACTTAT TAGAACTTTT GCGAACTTCT GATAACTTTG
ACTAACTTAA TCTAACTTCG GGACACTTGA TACCACTTCT
GCCCACTTTT AGGCACTTGG CATCACTTCC ACCGACTTCG
TCCGACTTAA AAATACTTGC GTATACTTAG CACTACTTGA
CGGTACTTAT ATGTACTTAA TTGTACTTCG GTTTACTTCT
GTAACCTTGT GGCACCTTGC CGGACCTTGG AATACCTTCC
CCTCCCTTAA CAAGCCTTAG TACGCCTTCC GCCGCCTTTC
GTCGCCTTGA CCGGCCTTTG CATGCCTTCT TCATCCTTGG
TACAGCTTTG GCCAGCTTCG CCGAGCTTCC GAACGCTTAG
ACACGCTTTA ATACGCTTGC CCCCGCTTTC AGCCGCTTGT
CTCCGCTTGA AAGCGCTTAA TAGCGCTTCG GCGCGCTTTG
GATCGCTTCT TCTCGCTTTT ACGGGCTTCT AATGGCTTTG
GCTGGCTTAA TGATGCTTCC CGCTGCTTAG TTCTGCTTCT
GGGTGCTTAC CTTTGCTTCC TAAATCTTCG GTAATCTTCA
ATGATCTTCG TTGATCTTAA CCACTCTTGG ATCCTCTTTG
GGAGTCTTCC GTCGTCTTCT TGGGTCTTAC CATGTCTTGA
ACATTCTTAT AAGTTCTTTT ACTTTCTTCG TCTTTCTTAA
CGAAAGTTTA ATAAAGTTTT CCCAAGTTGT AGCAAGTTTC
TCTAAGTTGC TTTAAGTTTA AGGCAGTTCC CATCAGTTGG
CCAGAGTTGA CTAGAGTTTC ACCGAGTTGC CGCGAGTTTT
ATCGAGTTTA TGTGAGTTTC AAATAGTTCG TAATAGTTAA
GAGTAGTTCA TCGTAGTTTA TTGTAGTTGC AATTAGTTAT
GGCACGTTCG CGGACGTTCC AATACGTTGG GTTACGTTAC
AGACCGTTTA CTACCGTTTT ACCCCGTTGT CGCCCGTTTC
GGGCCGTTTG TGTCCGTTTT TACGCGTTGG AGGGCGTTCT
CTGGCGTTCA GGTGCGTTAA GAATCGTTTC TCATCGTTCC
CCCTCGTTAG GCGTCGTTAC GCCAGGTTGC GTCAGGTTTA
CCGAGGTTGG ATACGGTTCG TTACGGTTAA TAGCGGTTGC
GTGCGGTTCA CGTCGGTTAA ATTCGGTTAT GTAGGGTTTT
GGCGGGTTTC CGGGGGTTTG TGATGGTTGG CTTTGGTTGG
AAAATGTTAA TAAATGTTCG GCAATGTTTG CACATGTTAC
GAGATGTTAG ACGATGTTTA ATGATGTTGC TATATGTTAT
CCACTGTTCC ACCCTGTTCA TCCCTGTTAG GGAGTGTTGG
AACGTGTTAT AGGGTGTTGA CTGGTGTTGT TTATTGTTTT
TGCTTGTTTC ACTTTGTTGC CGTTTGTTTT ATTTTGTTTA
GAAAATTTAC ATAAATTTGG CCCAATTTTG TAGAATTTCC
GCGAATTTTC GTGAATTTGA TACCATTTTC GCCCATTTCC
CCGCATTTCG CATCATTTTT CGCGATTTGG GGGGATTTGC
GCTTATTTGA GTTTATTTTC TAAACTTTTA GCAACTTTCA
ACGACTTTCG TCGACTTTAA AATACTTTTT CTACCTTTGG
GACCCTTTAA ACCCCTTTTG GGGCCTTTGT TGTCCTTTGG
TACGCTTTTT GCCGCTTTCT CATGCTTTTC CGATCTTTAA
ATATCTTTAT AGCTCTTTAC ATTTCTTTCG TTTTCTTTAA
CAAAGTTTAT CCGAGTTTTT AGGAGTTTGC CATAGTTTCG
CCCCGTTTCT GATCGTTTTC TCTCGTTTCC AAAGGTTTAC
GTAGGTTTGG CACGGTTTAA ACGGGTTTTC CGGGGTTTGT
ATGGGTTTGA TGATGTTTTT TCCTGTTTGA TTCTGTTTTC
AGTTGTTTTA CTTTGTTTTT GCAATTTTGT GGCATTTTTA
AGACTTTTCG TGACTTTTAA GGGCTTTTCA AGTCTTTTAT
CTTCTTTTAA GGAGTTTTTT GCCGTTTTGA GTCGTTTTTC
CTGGTTTTTG TTATTTTTGG AAGTTTTTCC CGTTTTTTGG
```

The foregoing code set is also applicable to the following dataset for Reed-Solomon 5+2 base, 256 sequence, 1 base error correction, 2 nocall correction:

```
AAAAAAA CCAAACA GCAAATG GGAAAGA TTAAATA AACAAGT
CACAACC ACCAAAC TCCAACG GGCAAAT CTCAATG GTCAACA
GAGAAGG AGGAAAG TGGAACC TATAATT AGTAACA ATTAAAT
AAACACC CAACAGT TAACAAG CCACAAC ATACATG CACCAAA
ACCCACA GTCCAAC CCGCATT TGGCAAA TTGCACT GATCAGC
GCTCAAT AGTCAAC TGTCACG CTTCAGA AAAGAGG TCAGACT
GGAGAAG CTAGATT GCCGATT AGCGATC GAGGAAA ACGGATG
AGGGAGA CTGGAAC CATGATA GATGACG TGTGAGC GTTGATC
AAATATT TGATACA CTATAGG TTATAAT GCCTAGG CGCTACG
GGCTATA TTCTAGA AAGTAAC TAGTACG ACGTAGT CCGTACC
GGGTAGC TTGTATC TATTAAA ATTTATA CAAACAC ACAACCC
CCAACGT TCAACAG GGAACCT GTAACAA AACACCA CCCACAA
TGCACTT GTCACGT CAGACTT ATGACGG GATACAT GCTACGC
AGTACGT CGTACCC CAACCCA GAACCTG ACACCAA GTACCCC
AACCCAC TACCCCG ACCCCGT CCCCCCC GGCCCGC TTCCCTC
GCGCCGG CGGCCCG GGGCCTA TTGCCGA TCTCCTT CGTCCAA
```

```
                         -continued
ATTCCGC CTTCCCT TCAGCGA TGAGCTG GTAGCGG TACGCGC

CCCGCGG TCCGCAT CGCGCTA GGCGCCG TAGGCTA GCGGCCC

AGGGCCT CGGGCGC ATGGCAA AATGCTC ATTGCCG TTTGCAC

CGATCAG TGATCGT GTATCTT CCCTCTT TGCTCAA TTCTCCT

CAGTCAA ACGTCCA GTGTCAC CATTCCG GATTCTA ACTTCAG

TCTTCCC CTTTCTC GAAAGAG ACAAGTA AGAAGGG AACAGTC

ATCAGCG TTCAGAC AAGAGGA GGGAGAA GTGAGCT TATAGGC

CCTAGGG TCTAGAT CGTAGTA GGTAGCG CAACGTC TCACGTG

TGACGGA CTACGCG GTACGTA CCCCGTA GCCCGCG CGCCGGG

TGCCGAT TTCCGCA CAGCGAT TAGCGGG ACGCGCT CCGCGGC

GGGCGCC GATCGTT GAAGGGA AGAGGAA ATAGGCT CTAGGGC

GACGGAT GCCGGGC AGCGGGT CGCGGCC AAGGGAG TAGGGCC

CCGGGCG GCGGGTA GGGGGGG TTGGGTG AATGGCA CCTGGAA

TGTGGTT GTTGGGT AAATGGC CAATGCT ACATGAT GGATGAC

ACCTGGA AGCTGTG ACGTGTC GGGTGTT CTGTGAG TTGTGGT

GATTGCC TCTTGTA CGTTGAT TGTTGGG CTTTGCA GTTTGTG

CAAATGG TAAATAT TCAATGC ATAATTT TACATGA CGCATTC

TAGATTC CCGATTG GCGATCA CGGATGA ATGATAC TTGATCG

AATATTA GCTATAG TGTATCT TTTATAA GCACTTT AGACTTC

AACCTGG TCCCTCT GGCCTAG CTCCTTT GAGCTGT GCGCTAC

AGGCTAT ATGCTCA TATCTTG CCTCTTC ATTCTAG TTTCTCC

CAAGTAA ACAGTCA GTAGTAC AACGTCC CACGTGT TACGTAG

CCCGTAC ATCGTTG CGGGTAG TGGGTGT GTGGTTT GCTGTGA

CGTGTCA GGTGTTG CTTGTAT TTTGTGG TAATTTA GCATTCC

AGATTCT CGATTGC ATATTAA CACTTTG GACTTCA TCCTTTC

ATCTTGT CTCTTCC TCGTTGA TGGTTTG GTGTTGG AATTTAT

ACTTTGC CCTTTCT GGTTTGT TTTTTTT
```

The error correction technique of the invention can be used in many applications. The technique will correct a base call 44 to a corrected base call 46, where the bases could part of a model system or a construct made of a tag and another sequence which could be an unknown sequence from a defined set. Once the DNA markers, for example DNA tags, are fully recovered by these methods, the population of identified bases can then be assembled to recover and correct sequence information for the target nucleic acid and/or identify the presence of particular sequences in the target nucleic acid. There is also potential for exploiting the higher accuracy of tag recovery in developing more efficient and potentially faster genome sequencing techniques, such as long fragment read (LFR) techniques. In some embodiments, the identified bases are assembled into a complete sequence through alignment of overlapping sequences obtained from multiple sequencing cycles performed on multiple DNBs. As used herein, the term "complete sequence" refers to the sequence of partial or whole genomes as well as partial or whole target nucleic acids.

Long Fragment Reads (LFR) technology enables independent sequencing and analysis of the two parental chromosomes in a diploid sample. See for example, US Published Patent Application US 2007/0072208 corresponding to PCT Published Patent Application WO2006/138284 published 28 Dec. 2006, which are incorporated herein by reference. As applied to the sequencing of polyploidy organisms, such as diploid human genomes, LFR allows heterozygote phasing over large intervals (potentially entire chromosomes), even in areas with high recombination rates. In addition, by distinguishing calls from the two chromosomes, LFR allows higher confidence calling of homozygous positions (>99% of the genome) at low coverage. Additional applications of LFR include, but are not limited to, resolution of extensive rearrangements in cancer genomes and full-length sequencing of alternatively spliced transcripts.

According to a typical application of LFR to human genomic DNA, genomic DNA of approximately 100 kbp is used as the input for LFR, as the length of input DNA impacts the interval over which phasing can be performed. This high molecular weight genomic DNA is aliquotted into a 384 well plate such that approximately 0.1 haploid genomes (10% of a haploid genome) are aliquotted into each well. The DNA fragments in each well are amplified, and this amplified DNA is fragmented to about 500 bp. The DNA in each well is ligated to adaptor aims containing a unique identifier, and the ligated DNA from all 384 wells is then pooled into a single tube.

This pooled DNA is then used as input to a standard library construction (such as that developed by Complete Genomics, Inc. of Mountain View, Calif.) and sequencing processes. In aggregate, the 384 wells will contain approximately 40 fragments, spanning each position in the genome, with about 20 fragments coming from the maternal chromosome and 20 from the paternal chromosome. At a rate of 0.1 genome equivalents per well, there is a 10% chance that fragments in a well will overlap, and a 50% chance that any such overlapping fragments are derived from separate parental chromosomes. Thus, approximately 95% of the data from a well will be derived from a single parental chromosome.

In order to resolve the parental chromosomes, the reads from each well are effectively assembled independently from other wells. The data is then mapped to one or more reference genomes, and the reads that map near each other are grouped by their unique identifiers, enabling reconstruction of the approximate 100 kbp haploid fragments in each well. Single nucleotide polymorphisms (SNPs) within the sample are then used to distinguish between 100 kbp fragments from the maternal and paternal chromosomes.

The initial 40 genome equivalents described above yield on average a 100 kbp maternal fragment starting every 5 kbp and a 100 kbp paternal fragment every 5 kbp. Thus, two consecutive maternal fragments will overlap each other on average by about 95 kbp. In the human genome, there are typically 50-150 Single Nucleotide Polymorphisms (SNPs) within 95 kbp, many of which will be heterozygous in any given sample.

Using these SNPs, maternal fragments are distinguished from paternal fragments. By chaining together overlapping fragments; large maternal and paternal segments (up to complete chromosomes) can be constructed separately. Phasing will not be possible across long repeat sections such as satellites in centromeric regions. But for most practical purposes LFR increases effective read length from 35 bp to over 100 kbp.

In further embodiments, assembly methods utilize algorithms that can be used to "piece together" overlapping sequences to provide a complete sequence. In still further embodiments, reference tables are used to assist in assembling the identified sequences into a complete sequence. A reference table may be compiled using existing sequencing data on the organism of choice. For example human genome data can be accessed through the National Center for Biotechnology Information at ftp.ncbi.nih.gov/refseq/release, or through the J. Craig Venter Institute at http://www.jcvi.org/researchhuref/. All or a subset of human genome information can be used to create a reference table for particular sequencing queries. In addition, specific reference tables can be constructed from empirical data derived from specific populations, including genetic sequence from humans with specific ethnicities, geographic heritage, religious or culturally-defined populations, as the variation within the human genome may slant the reference data depending upon the origin of the information contained therein.

In any of the embodiments of the invention discussed herein, a population of nucleic acid templates and/or DNBs may comprise a number of target nucleic acids to substantially cover a whole genome or a whole target polynucleotide. As used herein, "substantially covers" means that the amount of nucleotides (i.e., target sequences) analyzed contains an equivalent of at least two copies of the target polynucleotide, or in another aspect, at least ten copies, or in another aspect, at least twenty copies, or in another aspect, at least 100 copies. Target polynucleotides may include DNA fragments, including genomic DNA fragments and cDNA fragments, and RNA fragments. Guidance for the step of reconstructing target polynucleotide sequences can be found in the following references, which are incorporated by reference: Lander et al, *Genomics*, 2: 231-239 (1988); Vingron et al, *J. Mol. Biol.*, 235: 1-12 (1994); and like references.

Reed-Solomon (RS) code-based sensors in the form of DNB, beads and the like, may be spiked into into the mix of conventional genomic sensors on a substrate. For instance, one could construct a substrate sensor set with a mixture of 99.9% conventional genomic sensors and 0.1% RS sensors. After reading a series of bases, e.g., 10, one could select from the mix candidate RS sensors with high fidelity. The candidate RS sensors will be those that differ from the RS codes by at least K bases, where K is normally 0 or 1. These candidate RS sensors can be delivered to the RS decoding algorithm for the characterization of the system. A 0.1% spiking of RS in a lane of genomic information will provide sufficient information to enable RS analysis while providing minimal contamination to the genomic sequences, as a library would contain multiple RS codes in a DNA short-read. Other spiking densities are also contemplated, as for example as much as ten per cent but preferably in the range of one per cent to five per cent. The set that is spiked in is preferably a subset of the 4096 possible RS codes that are available. This subset is preferably optimized to have minimal hits to the genomic DNA. By doing so, no extra space needs to be set aside on the substrate for the RS sensor system. Moreover, for each lane of the genomic experiment, an internal control would be available, i.e., the RS sensors that are spiked in. Alternatively, the spiked-in RS sensors can have an independent short tag that would differentiate between them and the genomic data.

Figures 2, 3, 5:
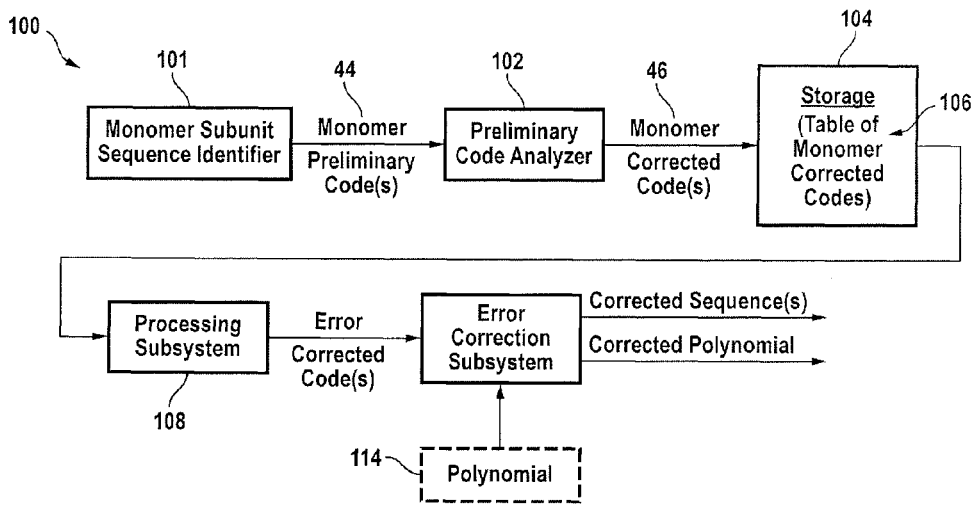
FIG. 2 is a table illustrating experimental results of the use of Reed-Solomon correction on a set of 7-mer DNA sequences.
FIG. 3 is a table summarizing a comparison of representation of a typical set of DNB calls showing improvements according to the invention
FIG. 5 is a depiction of an apparatus incorporating the invention.

FIG. 2 illustrates results of the use of Reed-Solomon correction on a set of 7-mer DNA sequences. Column 1 is an index. Column 2 is the calls of the observed sequence. Column 3 is the corrected sequence after error correction according to the invention. Column 4 indicates whether a call was recovered, i.e., changed from the observed call. Columns 5 through 11 are the scores at the seven positions for each of the bases in the seven-base sequence, i.e., the estimated likelihood that the original call was correct. The error in the scores could be a function of problems in either physical or optical interference between adjacent interrogation sites (cross-talk), a weak DNB at an interrogation site, a missing DNB at an interrogation site allowing a reading to be taken based on an adjacent interrogation site, problems in stripping, washing and flushing between sequencing cycles and errors in sequencing. In the course of processing and correction of five sequences, two bases were recovered. As a condition, the processing algorithm was blind to all scores and to all other sequences (when processing each sequence).

One of the outcomes of Reed-Solomon decoding of the genomic data is that certain sites do not result in a correction of a call. The no-call output is typically an indication that the interrogation site has more than one error, which is often the case when the interrogation site is empty and/or the report of an observed sequence is based on readings from adjacent interrogation sites (cross-talk). Thus the Reed-Solomon decoding actually identifies bad interrogation sites. FIG. 3 is a table summarizing an experiment comparing observed sequences and Reed-Solomon corrected sequences. Column 1 is the categories of A. Valid Sequences, B. Uncalled Sequences, C. Invalid Sequences, and D. Total Sequences accounted for. There was a total of 50625 7-mer sequences accounted for. Of that, 20647 were observed valid sequences and 29978 invalid sequences. After Reed-Solomon correction, the number of valid sequences increased to 35317 and 15308 sequences were designated as no-calls, eliminating all invalid sequences from the set. The result is that the Reed-Solomon correction technique was able to recover about 70% of the valid DNBs and suppress the empty interrogation sites and low-quality DNBs by designating them as no-calls.

The inventive method can operate on blocks of delimited sets of monomer subunits that are artificial DNA sequences. The artificial DNA sequences are made up of oligonucleotides, or at least one oligonucleotide. The method according to the invention works on real systems containing tags, as well as in model systems where the model content is known and used to characterize real systems. Tags may be employed in Long Fragment Read techniques. Tags are useful particularly in multiplexing a plurality of individual samples, in multiplexing a plurality of tissues of a sample, and in multiplexing multiple libraries of a sample.

In the preparation of samples wherein the monomer subunit sequence has tags, the physical elements containing the tags can be randomly placed on a substrate, the tags being used as markers to identify both location and type of subunit sequence.

It should be understood that the delimited set of monomer subunits referred to herein encompasses a sequence of nucleotides and/or a sequence of amino acids, both natural and artificial, and oligleonucleotides, both natural and artificial.

The methodology thus improves the accuracy and efficiency of DNA sequencing for a model system by increasing the true positives and true negatives, and decreasing the number of false positives and false negatives. It is also useful as a check against other sensor systems. There are numerous applications for fully-recoverable set of DNA tags. In addition to improving the accuracy of genome mapping (not applicable to genome mapping), if it were known that the DNA tags were accurate, then the other sources of error or imperfections in the analysis and preparation processes could be better identified and the errors and improvements could be quantified. Furthermore, other methods of error correction verification can be verified and calibrated. Still further, various techniques for verification and error correction can be combined to provide even higher efficiency and accuracy in the sequencing process.

FIG. 4 is a representative figure similar to FIG. 2 intended to depict 10-base codes that are a preferred embodiment.

FIG. 5 depicts a generalized apparatus 100 incorporating and operative according to another aspect of the invention. The apparatus 100 is for processing errors in data used for identifying a sequence of an oriented linear heteropolymer, such as a polynucleotide, a oligonucleotide, an amino acid and a DNA sequence, including both natural and artificial sequence types. Processing includes either identifying one or more errors in the sequence or correcting one or more errors in the sequence. The apparatus includes a subsystem 101 operative to identify the monomer subunit sequence in order to obtain preliminary codes 44, the preliminary codes intended to resemble members of an expected known delimited code set of block codes. The sequence identifier may identify as little as one preliminary code or sequence but it is preferable to identify several sequences or codes. There may be an optional analysis subsystem 102 for preliminary analysis of the preliminary codes 44 using a computer processing system, in order to obtain (analyzed) candidate codes 46. The candidate codes are stored in a table 106 in a storage subsystem 104 to expedite the processing of several sequences or codes together. The candidate codes or sequences 46 are retrieved from the storage subsystem 104 and provided to an error correction/detection, a processing subsystem 108 for detecting errors or invoking error correction. The output of subsystem 108 is an output code 114. The output code may take the form of the sequence or sequence listing that has been corrected according to the invention or a set of indicators of error content for each sequence, such as zero, one or two errors, or a no-call, indicating that the sequence is not identifiable. This system can be used for modeling, tagging, spiking of natural sequences for identification, and for error correction to correct for errors in the initial (visual) readings and, for model systems, sequence calling for a known system.

According to the invention, compositions may be formed, such as for use in modeling and improved genome sequencing, as well as other applications. Compositions may comprise linear oriented heteropolymers of blocks of monomer subunit sequence having coding of an expected known delimited code set of block codes, and specifically Reed-Solomon codes, namely codes produced according to the Reed-Solomon algorithm, and specifically those of a length between 5 and ten monomer subunits, wherein the ratio of distance between codes and length of code is at least 20 percent. Specific heteropolymer components may include polypeptides, polynucleotides, such as DNA nanoballs, oligonucleotides Such a composition may include and be attached to a substrate wherein the heteropolymers are attached at spaced apart interrogation sites, and the sites of attachment may be ordered or randomly arranged.

The present specification provides a complete description of the methodologies, systems and/or structures and uses thereof in example aspects of the presently-described technology. Although various aspects of this technology have been described above with a certain degree of particularity, or with reference to one or more individual aspects, those skilled in the art could make numerous alterations to the disclosed aspects without departing from the spirit or scope of the technology hereof. Since many aspects can be made without departing from the spirit and scope of the presently described technology, the appropriate scope resides in the claims hereinafter appended. Other aspects are therefore contemplated. Furthermore, it should be understood that any operations may be performed in any order, unless explicitly claimed otherwise or a specific order is inherently necessitated by the claim language. It is intended that all matter contained in the above description and shown in the accompanying drawings shall be interpreted as illustrative only of particular aspects and are not limiting to the embodiments shown. Unless otherwise clear from the context or expressly stated, any concentration values provided herein are generally given in terms of admixture values or percentages without regard to any conversion that occurs upon or following addition of the particular component of the mixture. To the extent not already expressly incorporated herein, all published references and patent documents referred to in this disclosure are incorporated herein by reference in their entirety for all purposes. Changes in detail or structure may be made without departing from the basic elements of the present technology as defined in the following claims.

SEQUENCE LISTING (4105 sequences)

SEQ ID NO: 1 - DNA, 10 bp, Artificial Sequence
  synthetic Reed-Solomon code for 8+2 base, 1 base error, 2 nocall correction
taaaaaaagg

SEQ ID NO: 2 - DNA, 10 bp, Artificial Sequence
  synthetic Reed-Solomon code for 8+2 base, 1 base error, 2 nocall correction
atgaaaaacc

SEQ ID NO: 3 - DNA, 10 bp, Artificial Sequence
  synthetic Reed-Solomon code for 8+2 base, 1 base error, 2 nocall correction
ccacaaaagc

SEQ ID NO: 4 - DNA, 10 bp, Artificial Sequence
  synthetic Reed-Solomon code for 8+2 base, 1 base error, 2 nocall correction
agacaaaatt

SEQ ID NO: 5 - DNA, 10 bp, Artificial Sequence
  synthetic Reed-Solomon code for 8+2 base, 1 base error, 2 nocall correction
ctacaaaata

SEQ ID NO: 6 - DNA, 10 bp, Artificial Sequence
  synthetic Reed-Solomon code for 8+2 base, 1 base error, 2 nocall correction
acccaaaaga

SEQ ID NO: 7 - DNA, 10 bp, Artificial Sequence
  synthetic Reed-Solomon code for 8+2 base, 1 base error, 2 nocall correction
atccaaaatc

SEQ ID NO: 8 - DNA, 10 bp, Artificial Sequence
  synthetic Reed-Solomon code for 8+2 base, 1 base error, 2 nocall correction
tgtcaaaata

SEQ ID NO: 9 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
ggagaaaacg

SEQ ID NO: 10 - DNA, 10 bp, Artificial Sequence
  synthetic Reed-Solomon code for 8+2 base, 1 base error, 2 nocall correction
agggaaaaca

SEQ ID NO: 11 - DNA, 10 bp, Artificial Sequence
  synthetic Reed-Solomon code for 8+2 base, 1 base error, 2 nocall correction
tgggaaaaag

SEQ ID NO: 12 - DNA, 10 bp, Artificial Sequence
  synthetic Reed-Solomon code for 8+2 base, 1 base error, 2 nocall correction
ctggaaaact

SEQ ID NO: 13 - DNA, 10 bp, Artificial Sequence
  synthetic Reed-Solomon code for 8+2 base, 1 base error, 2 nocall correction
ggtgaaaaat

SEQ ID NO: 14 - DNA, 10 bp, Artificial Sequence
  synthetic Reed-Solomon code for 8+2 base, 1 base error, 2 nocall correction
acttaaaacc

SEQ ID NO: 15 - DNA, 10 bp, Artificial Sequence
  synthetic Reed-Solomon code for 8+2 base, 1 base error, 2 nocall correction
acaacaaagc

SEQ ID NO: 16 - DNA, 10 bp, Artificial Sequence
  synthetic Reed-Solomon code for 8+2 base, 1 base error, 2 nocall correction
cgaacaaatt

SEQ ID NO: 17 - DNA, 10 bp, Artificial Sequence
  synthetic Reed-Solomon code for 8+2 base, 1 base error, 2 nocall correction
ataacaaata

SEQ ID NO: 18 - DNA, 10 bp, Artificial Sequence
  synthetic Reed-Solomon code for 8+2 base, 1 base error, 2 nocall correction
cccacaaaga

SEQ ID NO: 19 - DNA, 10 bp, Artificial Sequence
  synthetic Reed-Solomon code for 8+2 base, 1 base error, 2 nocall correction
ctcacaaatc

SEQ ID NO: 20 - DNA, 10 bp, Artificial Sequence
  synthetic Reed-Solomon code for 8+2 base, 1 base error, 2 nocall correction
gtgacaaatg

SEQ ID NO: 21 - DNA, 10 bp, Artificial Sequence
  synthetic Reed-Solomon code for 8+2 base, 1 base error, 2 nocall correction
tttacaaatt

SEQ ID NO: 22 - DNA, 10 bp, Artificial Sequence
  synthetic Reed-Solomon code for 8+2 base, 1 base error, 2 nocall correction
gtcccaaacg

SEQ ID NO: 23 - DNA, 10 bp, Artificial Sequence
  synthetic Reed-Solomon code for 8+2 base, 1 base error, 2 nocall correction
ctgccaaacc

SEQ ID NO: 24 - DNA, 10 bp, Artificial Sequence
  synthetic Reed-Solomon code for 8+2 base, 1 base error, 2 nocall correction
ggtccaaaac

SEQ ID NO: 25 - DNA, 10 bp, Artificial Sequence
  synthetic Reed-Solomon code for 8+2 base, 1 base error, 2 nocall correction
ccagcaaagt

SEQ ID NO: 26 - DNA, 10 bp, Artificial Sequence
  synthetic Reed-Solomon code for 8+2 base, 1 base error, 2 nocall correction
agagcaaatc

SEQ ID NO: 27 - DNA, 10 bp, Artificial Sequence
  synthetic Reed-Solomon code for 8+2 base, 1 base error, 2 nocall correction
cgcgcaaata

SEQ ID NO: 28 - DNA, 10 bp, Artificial Sequence
  synthetic Reed-Solomon code for 8+2 base, 1 base error, 2 nocall correction
atcgcaaatt

SEQ ID NO: 29 - DNA, 10 bp, Artificial Sequence
  synthetic Reed-Solomon code for 8+2 base, 1 base error, 2 nocall correction
taatcaaaat

SEQ ID NO: 30 - DNA, 10 bp, Artificial Sequence
  synthetic Reed-Solomon code for 8+2 base, 1 base error, 2 nocall correction
gagtcaaact

SEQ ID NO: 31 - DNA, 10 bp, Artificial Sequence
  synthetic Reed-Solomon code for 8+2 base, 1 base error, 2 nocall correction
tcgtcaaatt

SEQ ID NO: 32 - DNA, 10 bp, Artificial Sequence
  synthetic Reed-Solomon code for 8+2 base, 1 base error, 2 nocall correction
aattcaaaaa

SEQ ID NO: 33 - DNA, 10 bp, Artificial Sequence
  synthetic Reed-Solomon code for 8+2 base, 1 base error, 2 nocall correction
tattcaaacg

SEQ ID NO: 34 - DNA, 10 bp, Artificial Sequence
  synthetic Reed-Solomon code for 8+2 base, 1 base error, 2 nocall correction
gcttcaaatg

SEQ ID NO: 35 - DNA, 10 bp, Artificial Sequence
  synthetic Reed-Solomon code for 8+2 base, 1 base error, 2 nocall correction
agaagaaacg

SEQ ID NO: 36 - DNA, 10 bp, Artificial Sequence
  synthetic Reed-Solomon code for 8+2 base, 1 base error, 2 nocall correction
tgaagaaaaa

SEQ ID NO: 37 - DNA, 10 bp, Artificial Sequence
  synthetic Reed-Solomon code for 8+2 base, 1 base error, 2 nocall correction
gggagaaaca

SEQ ID NO: 38 - DNA, 10 bp, Artificial Sequence
  synthetic Reed-Solomon code for 8+2 base, 1 base error, 2 nocall correction
agtagaaaat

SEQ ID NO: 39 - DNA, 10 bp, Artificial Sequence
  synthetic Reed-Solomon code for 8+2 base, 1 base error, 2 nocall correction
cttagaaaaa

SEQ ID NO: 40 - DNA, 10 bp, Artificial Sequence
  synthetic Reed-Solomon code for 8+2 base, 1 base error, 2 nocall correction
gcacgaaagt

SEQ ID NO: 41 - DNA, 10 bp, Artificial Sequence
  synthetic Reed-Solomon code for 8+2 base, 1 base error, 2 nocall correction
ggccgaaata

SEQ ID NO: 42 - DNA, 10 bp, Artificial Sequence
  synthetic Reed-Solomon code for 8+2 base, 1 base error, 2 nocall correction
ttaggaaaac

SEQ ID NO: 43 - DNA, 10 bp, Artificial Sequence
  synthetic Reed-Solomon code for 8+2 base, 1 base error, 2 nocall correction
tgcggaaaat

SEQ ID NO: 44 - DNA, 10 bp, Artificial Sequence
  synthetic Reed-Solomon code for 8+2 base, 1 base error, 2 nocall correction
ctcggaaacg

SEQ ID NO: 45 - DNA, 10 bp, Artificial Sequence
  synthetic Reed-Solomon code for 8+2 base, 1 base error, 2 nocall correction
tagggaaaga

SEQ ID NO: 46 - DNA, 10 bp, Artificial Sequence
  synthetic Reed-Solomon code for 8+2 base, 1 base error, 2 nocall correction
gtgggaaacc

SEQ ID NO: 47 - DNA, 10 bp, Artificial Sequence
  synthetic Reed-Solomon code for 8+2 base, 1 base error, 2 nocall correction
cgtggaaaac

SEQ ID NO: 48 - DNA, 10 bp, Artificial Sequence
  synthetic Reed-Solomon code for 8+2 base, 1 base error, 2 nocall correction
caatgaaata

SEQ ID NO: 49 - DNA, 10 bp, Artificial Sequence
  synthetic Reed-Solomon code for 8+2 base, 1 base error, 2 nocall correction
aactgaaatc

SEQ ID NO: 50 - DNA, 10 bp, Artificial Sequence
  synthetic Reed-Solomon code for 8+2 base, 1 base error, 2 nocall correction
ccgtgaaaaa

SEQ ID NO: 51 - DNA, 10 bp, Artificial Sequence
  synthetic Reed-Solomon code for 8+2 base, 1 base error, 2 nocall correction
cccataaact

SEQ ID NO: 52 - DNA, 10 bp, Artificial Sequence
  synthetic Reed-Solomon code for 8+2 base, 1 base error, 2 nocall correction
gatataaatc

SEQ ID NO: 53 - DNA, 10 bp, Artificial Sequence
  synthetic Reed-Solomon code for 8+2 base, 1 base error, 2 nocall correction
tctataaacc

SEQ ID NO: 54 - DNA, 10 bp, Artificial Sequence
  synthetic Reed-Solomon code for 8+2 base, 1 base error, 2 nocall correction
caactaaaat

SEQ ID NO: 55 - DNA, 10 bp, Artificial Sequence
  synthetic Reed-Solomon code for 8+2 base, 1 base error, 2 nocall correction
ccgctaaatt

SEQ ID NO: 56 - DNA, 10 bp, Artificial Sequence
  synthetic Reed-Solomon code for 8+2 base, 1 base error, 2 nocall correction
aggctaaagc

SEQ ID NO: 57 - DNA, 10 bp, Artificial Sequence
  synthetic Reed-Solomon code for 8+2 base, 1 base error, 2 nocall correction
catctaaacg

SEQ ID NO: 58 - DNA, 10 bp, Artificial Sequence
  synthetic Reed-Solomon code for 8+2 base, 1 base error, 2 nocall correction
ccagtaaaca

SEQ ID NO: 59 - DNA, 10 bp, Artificial Sequence
  synthetic Reed-Solomon code for 8+2 base, 1 base error, 2 nocall correction
accgtaaacc

SEQ ID NO: 60 - DNA, 10 bp, Artificial Sequence
  synthetic Reed-Solomon code for 8+2 base, 1 base error, 2 nocall correction
aaattaaagg

SEQ ID NO: 61 - DNA, 10 bp, Artificial Sequence
  synthetic Reed-Solomon code for 8+2 base, 1 base error, 2 nocall correction
gtattaaaac

SEQ ID NO: 62 - DNA, 10 bp, Artificial Sequence
  synthetic Reed-Solomon code for 8+2 base, 1 base error, 2 nocall correction
ggcttaaaat

SEQ ID NO: 63 - DNA, 10 bp, Artificial Sequence
  synthetic Reed-Solomon code for 8+2 base, 1 base error, 2 nocall correction
gagttaaaga

SEQ ID NO: 64 - DNA, 10 bp, Artificial Sequence
  synthetic Reed-Solomon code for 8+2 base, 1 base error, 2 nocall correction
ttgttaaacc

SEQ ID NO: 65 - DNA, 10 bp, Artificial Sequence
  synthetic Reed-Solomon code for 8+2 base, 1 base error, 2 nocall correction
aaaaacaagc

SEQ ID NO: 66 - DNA, 10 bp, Artificial Sequence
  synthetic Reed-Solomon code for 8+2 base, 1 base error, 2 nocall correction
gtaaacaaag

SEQ ID NO: 67 - DNA, 10 bp, Artificial Sequence
  synthetic Reed-Solomon code for 8+2 base, 1 base error, 2 nocall correction
cacaacaaga

SEQ ID NO: 68 - DNA, 10 bp, Artificial Sequence
  synthetic Reed-Solomon code for 8+2 base, 1 base error, 2 nocall correction
cggaacaaat

SEQ ID NO: 69 - DNA, 10 bp, Artificial Sequence
  synthetic Reed-Solomon code for 8+2 base, 1 base error, 2 nocall correction
atgaacaaaa

SEQ ID NO: 70 - DNA, 10 bp, Artificial Sequence
  synthetic Reed-Solomon code for 8+2 base, 1 base error, 2 nocall correction
ttgaacaacg

SEQ ID NO: 71 - DNA, 10 bp, Artificial Sequence
  synthetic Reed-Solomon code for 8+2 base, 1 base error, 2 nocall correction
gttaacaact

SEQ ID NO: 72 - DNA, 10 bp, Artificial Sequence
  synthetic Reed-Solomon code for 8+2 base, 1 base error, 2 nocall correction
ttccacaatg

SEQ ID NO: 73 - DNA, 10 bp, Artificial Sequence
  synthetic Reed-Solomon code for 8+2 base, 1 base error, 2 nocall correction
caagacaagt

SEQ ID NO: 74 - DNA, 10 bp, Artificial Sequence
  synthetic Reed-Solomon code for 8+2 base, 1 base error, 2 nocall correction
agggacaaac

SEQ ID NO: 75 - DNA, 10 bp, Artificial Sequence
  synthetic Reed-Solomon code for 8+2 base, 1 base error, 2 nocall correction
tcatacaaat

SEQ ID NO: 76 - DNA, 10 bp, Artificial Sequence
  synthetic Reed-Solomon code for 8+2 base, 1 base error, 2 nocall correction
tagtacaatt

SEQ ID NO: 77 - DNA, 10 bp, Artificial Sequence
  synthetic Reed-Solomon code for 8+2 base, 1 base error, 2 nocall correction
gcgtacaact

SEQ ID NO: 78 - DNA, 10 bp, Artificial Sequence
  synthetic Reed-Solomon code for 8+2 base, 1 base error, 2 nocall correction
gattacaatg

SEQ ID NO: 79 - DNA, 10 bp, Artificial Sequence
  synthetic Reed-Solomon code for 8+2 base, 1 base error, 2 nocall correction
acttacaaaa

SEQ ID NO: 80 - DNA, 10 bp, Artificial Sequence
  synthetic Reed-Solomon code for 8+2 base, 1 base error, 2 nocall correction
tcttacaacg

SEQ ID NO: 81 - DNA, 10 bp, Artificial Sequence
  synthetic Reed-Solomon code for 8+2 base, 1 base error, 2 nocall correction
tcaaccaagg

SEQ ID NO: 82 - DNA, 10 bp, Artificial Sequence
  synthetic Reed-Solomon code for 8+2 base, 1 base error, 2 nocall correction
caacccaagc

SEQ ID NO: 83 - DNA, 10 bp, Artificial Sequence
  synthetic Reed-Solomon code for 8+2 base, 1 base error, 2 nocall correction
aaccccaaga

SEQ ID NO: 84 - DNA, 10 bp, Artificial Sequence
  synthetic Reed-Solomon code for 8+2 base, 1 base error, 2 nocall correction
aggcccaaat

SEQ ID NO: 85 - DNA, 10 bp, Artificial Sequence
  synthetic Reed-Solomon code for 8+2 base, 1 base error, 2 nocall correction
ctgcccaaaa

SEQ ID NO: 86 - DNA, 10 bp, Artificial Sequence
  synthetic Reed-Solomon code for 8+2 base, 1 base error, 2 nocall correction
ggtcccaaca

SEQ ID NO: 87 - DNA, 10 bp, Artificial Sequence
  synthetic Reed-Solomon code for 8+2 base, 1 base error, 2 nocall correction
tgagccaatg

SEQ ID NO: 88 - DNA, 10 bp, Artificial Sequence
  synthetic Reed-Solomon code for 8+2 base, 1 base error, 2 nocall correction
cttgccaatg

SEQ ID NO: 89 - DNA, 10 bp, Artificial Sequence
  synthetic Reed-Solomon code for 8+2 base, 1 base error, 2 nocall correction
gtatccaagt

SEQ ID NO: 90 - DNA, 10 bp, Artificial Sequence
  synthetic Reed-Solomon code for 8+2 base, 1 base error, 2 nocall correction
ggctccaagc

SEQ ID NO: 91 - DNA, 10 bp, Artificial Sequence
  synthetic Reed-Solomon code for 8+2 base, 1 base error, 2 nocall correction
cggtccaagg

SEQ ID NO: 92 - DNA, 10 bp, Artificial Sequence
  synthetic Reed-Solomon code for 8+2 base, 1 base error, 2 nocall correction
aattccaacc

SEQ ID NO: 93 - DNA, 10 bp, Artificial Sequence
  synthetic Reed-Solomon code for 8+2 base, 1 base error, 2 nocall correction
tgaagcaacc

SEQ ID NO: 94 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
cgcagcaaag

SEQ ID NO: 95 - DNA, 10 bp, Artificial Sequence
  synthetic Reed-Solomon code for 8+2 base, 1 base error, 2 nocall correction
ttcagcaact

SEQ ID NO: 96 - DNA, 10 bp, Artificial Sequence
  synthetic Reed-Solomon code for 8+2 base, 1 base error, 2 nocall correction
gggagcaaac

SEQ ID NO: 97 - DNA, 10 bp, Artificial Sequence
  synthetic Reed-Solomon code for 8+2 base, 1 base error, 2 nocall correction
cttagcaacc

SEQ ID NO: 98 - DNA, 10 bp, Artificial Sequence
  synthetic Reed-Solomon code for 8+2 base, 1 base error, 2 nocall correction
ttgcgcaatt

SEQ ID NO: 99 - DNA, 10 bp, Artificial Sequence
  synthetic Reed-Solomon code for 8+2 base, 1 base error, 2 nocall correction
gttcgcaatg

SEQ ID NO: 100 - DNA, 10 bp, Artificial Sequence
  synthetic Reed-Solomon code for 8+2 base, 1 base error, 2 nocall correction
gaaggcaagc

SEQ ID NO: 101 - DNA, 10 bp, Artificial Sequence
  synthetic Reed-Solomon code for 8+2 base, 1 base error, 2 nocall correction
ataggcaaag

SEQ ID NO: 102 - DNA, 10 bp, Artificial Sequence
  synthetic Reed-Solomon code for 8+2 base, 1 base error, 2 nocall correction
ttaggcaaca

SEQ ID NO: 103 - DNA, 10 bp, Artificial Sequence
  synthetic Reed-Solomon code for 8+2 base, 1 base error, 2 nocall correction
gtgggcaaaa

SEQ ID NO: 104 - DNA, 10 bp, Artificial Sequence
  synthetic Reed-Solomon code for 8+2 base, 1 base error, 2 nocall correction
cgtggcaaca

SEQ ID NO: 105 - DNA, 10 bp, Artificial Sequence
  synthetic Reed-Solomon code for 8+2 base, 1 base error, 2 nocall correction
attggcaact

SEQ ID NO: 106 - DNA, 10 bp, Artificial Sequence
  synthetic Reed-Solomon code for 8+2 base, 1 base error, 2 nocall correction
tactgcaatg

SEQ ID NO: 107 - DNA, 10 bp, Artificial Sequence
  synthetic Reed-Solomon code for 8+2 base, 1 base error, 2 nocall correction
gcctgcaacg

SEQ ID NO: 108 - DNA, 10 bp, Artificial Sequence
  synthetic Reed-Solomon code for 8+2 base, 1 base error, 2 nocall correction
ccgtgcaacc

SEQ ID NO: 109 - DNA, 10 bp, Artificial Sequence
  synthetic Reed-Solomon code for 8+2 base, 1 base error, 2 nocall correction
acaatcaaat

SEQ ID NO: 110 - DNA, 10 bp, Artificial Sequence
  synthetic Reed-Solomon code for 8+2 base, 1 base error, 2 nocall correction
aagatcaatt

SEQ ID NO: 111 - DNA, 10 bp, Artificial Sequence
  synthetic Reed-Solomon code for 8+2 base, 1 base error, 2 nocall correction
actatcaacg

SEQ ID NO: 112 - DNA, 10 bp, Artificial Sequence
  synthetic Reed-Solomon code for 8+2 base, 1 base error, 2 nocall correction
tctatcaaaa

SEQ ID NO: 113 - DNA, 10 bp, Artificial Sequence
  synthetic Reed-Solomon code for 8+2 base, 1 base error, 2 nocall correction
aacctcaact

SEQ ID NO: 114 - DNA, 10 bp, Artificial Sequence
  synthetic Reed-Solomon code for 8+2 base, 1 base error, 2 nocall correction
tggctcaagg

SEQ ID NO: 115 - DNA, 10 bp, Artificial Sequence
  synthetic Reed-Solomon code for 8+2 base, 1 base error, 2 nocall correction
ggtctcaagt

SEQ ID NO: 116 - DNA, 10 bp, Artificial Sequence
  synthetic Reed-Solomon code for 8+2 base, 1 base error, 2 nocall correction
ccagtcaaac

SEQ ID NO: 117 - DNA, 10 bp, Artificial Sequence
  synthetic Reed-Solomon code for 8+2 base, 1 base error, 2 nocall correction
gacgtcaatg

SEQ ID NO: 118 - DNA, 10 bp, Artificial Sequence
  synthetic Reed-Solomon code for 8+2 base, 1 base error, 2 nocall correction
accgtcaaaa

SEQ ID NO: 119 - DNA, 10 bp, Artificial Sequence
  synthetic Reed-Solomon code for 8+2 base, 1 base error, 2 nocall correction
tccgtcaacg

SEQ ID NO: 120 - DNA, 10 bp, Artificial Sequence
  synthetic Reed-Solomon code for 8+2 base, 1 base error, 2 nocall correction
caggtcaatc

SEQ ID NO: 121 - DNA, 10 bp, Artificial Sequence
  synthetic Reed-Solomon code for 8+2 base, 1 base error, 2 nocall correction
taattcaagc

SEQ ID NO: 122 - DNA, 10 bp, Artificial Sequence
  synthetic Reed-Solomon code for 8+2 base, 1 base error, 2 nocall correction
gtattcaaca

SEQ ID NO: 123 - DNA, 10 bp, Artificial Sequence
  synthetic Reed-Solomon code for 8+2 base, 1 base error, 2 nocall correction
atgttcaacg

SEQ ID NO: 124 - DNA, 10 bp, Artificial Sequence
  synthetic Reed-Solomon code for 8+2 base, 1 base error, 2 nocall correction
ttgttcaaaa

SEQ ID NO: 125 - DNA, 10 bp, Artificial Sequence
  synthetic Reed-Solomon code for 8+2 base, 1 base error, 2 nocall correction
aaaaagaacg

SEQ ID NO: 126 - DNA, 10 bp, Artificial Sequence
  synthetic Reed-Solomon code for 8+2 base, 1 base error, 2 nocall correction
taaaagaaaa

SEQ ID NO: 127 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
gagaagaaca

SEQ ID NO: 128 - DNA, 10 bp, Artificial Sequence
  synthetic Reed-Solomon code for 8+2 base, 1 base error, 2 nocall correction
tcgaagaata

SEQ ID NO: 129 - DNA, 10 bp, Artificial Sequence
  synthetic Reed-Solomon code for 8+2 base, 1 base error, 2 nocall correction
ttgaagaagc

SEQ ID NO: 130 - DNA, 10 bp, Artificial Sequence
  synthetic Reed-Solomon code for 8+2 base, 1 base error, 2 nocall correction
aataagaaat

SEQ ID NO: 131 - DNA, 10 bp, Artificial Sequence
  synthetic Reed-Solomon code for 8+2 base, 1 base error, 2 nocall correction
gaccagaata

SEQ ID NO: 132 - DNA, 10 bp, Artificial Sequence
  synthetic Reed-Solomon code for 8+2 base, 1 base error, 2 nocall correction
acccagaaag

SEQ ID NO: 133 - DNA, 10 bp, Artificial Sequence
  synthetic Reed-Solomon code for 8+2 base, 1 base error, 2 nocall correction
tcccagaaca

SEQ ID NO: 134 - DNA, 10 bp, Artificial Sequence
  synthetic Reed-Solomon code for 8+2 base, 1 base error, 2 nocall correction
tacgagaaat

SEQ ID NO: 135 - DNA, 10 bp, Artificial Sequence
  synthetic Reed-Solomon code for 8+2 base, 1 base error, 2 nocall correction
tgggagaaga

SEQ ID NO: 136 - DNA, 10 bp, Artificial Sequence
  synthetic Reed-Solomon code for 8+2 base, 1 base error, 2 nocall correction
catgagaaac

SEQ ID NO: 137 - DNA, 10 bp, Artificial Sequence
  synthetic Reed-Solomon code for 8+2 base, 1 base error, 2 nocall correction
cgatagaata

SEQ ID NO: 138 - DNA, 10 bp, Artificial Sequence
  synthetic Reed-Solomon code for 8+2 base, 1 base error, 2 nocall correction
atatagaatt

SEQ ID NO: 139 - DNA, 10 bp, Artificial Sequence
  synthetic Reed-Solomon code for 8+2 base, 1 base error, 2 nocall correction
ccctagaagt

SEQ ID NO: 140 - DNA, 10 bp, Artificial Sequence
  synthetic Reed-Solomon code for 8+2 base, 1 base error, 2 nocall correction
agctagaatc

SEQ ID NO: 141 - DNA, 10 bp, Artificial Sequence
  synthetic Reed-Solomon code for 8+2 base, 1 base error, 2 nocall correction
tcttagaagc

SEQ ID NO: 142 - DNA, 10 bp, Artificial Sequence
  synthetic Reed-Solomon code for 8+2 base, 1 base error, 2 nocall correction
ttttagaata

SEQ ID NO: 143 - DNA, 10 bp, Artificial Sequence
  synthetic Reed-Solomon code for 8+2 base, 1 base error, 2 nocall correction
gaaacgaatc

SEQ ID NO: 144 - DNA, 10 bp, Artificial Sequence
  synthetic Reed-Solomon code for 8+2 base, 1 base error, 2 nocall correction
tcaacgaacc

SEQ ID NO: 145 - DNA, 10 bp, Artificial Sequence
  synthetic Reed-Solomon code for 8+2 base, 1 base error, 2 nocall correction
cccacgaaag

SEQ ID NO: 146 - DNA, 10 bp, Artificial Sequence
  synthetic Reed-Solomon code for 8+2 base, 1 base error, 2 nocall correction
gcgacgaaac

SEQ ID NO: 147 - DNA, 10 bp, Artificial Sequence
  synthetic Reed-Solomon code for 8+2 base, 1 base error, 2 nocall correction
caaccgaacg

SEQ ID NO: 148 - DNA, 10 bp, Artificial Sequence
  synthetic Reed-Solomon code for 8+2 base, 1 base error, 2 nocall correction
tacccgaaac

SEQ ID NO: 149 - DNA, 10 bp, Artificial Sequence
  synthetic Reed-Solomon code for 8+2 base, 1 base error, 2 nocall correction
catccgaaat

SEQ ID NO: 150 - DNA, 10 bp, Artificial Sequence
  synthetic Reed-Solomon code for 8+2 base, 1 base error, 2 nocall correction
cctgcgaaca

SEQ ID NO: 151 - DNA, 10 bp, Artificial Sequence
  synthetic Reed-Solomon code for 8+2 base, 1 base error, 2 nocall correction
ggctcgaacg

SEQ ID NO: 152 - DNA, 10 bp, Artificial Sequence
  synthetic Reed-Solomon code for 8+2 base, 1 base error, 2 nocall correction
cggtcgaacc

SEQ ID NO: 153 - DNA, 10 bp, Artificial Sequence
  synthetic Reed-Solomon code for 8+2 base, 1 base error, 2 nocall correction
aattcgaagg

SEQ ID NO: 154 - DNA, 10 bp, Artificial Sequence
  synthetic Reed-Solomon code for 8+2 base, 1 base error, 2 nocall correction
gtttcgaaac

SEQ ID NO: 155 - DNA, 10 bp, Artificial Sequence
  synthetic Reed-Solomon code for 8+2 base, 1 base error, 2 nocall correction
tgaaggaagg

SEQ ID NO: 156 - DNA, 10 bp, Artificial Sequence
  synthetic Reed-Solomon code for 8+2 base, 1 base error, 2 nocall correction
cttaggaagg

SEQ ID NO: 157 - DNA, 10 bp, Artificial Sequence
  synthetic Reed-Solomon code for 8+2 base, 1 base error, 2 nocall correction
aaacggaatt

SEQ ID NO: 158 - DNA, 10 bp, Artificial Sequence
  synthetic Reed-Solomon code for 8+2 base, 1 base error, 2 nocall correction
acgcggaaat

SEQ ID NO: 159 - DNA, 10 bp, Artificial Sequence
  synthetic Reed-Solomon code for 8+2 base, 1 base error, 2 nocall correction
tatcggaata

SEQ ID NO: 160 - DNA, 10 bp, Artificial Sequence
  synthetic Reed-Solomon code for 8+2 base, 1 base error, 2 nocall correction
gctcggaaca

SEQ ID NO: 161 - DNA, 10 bp, Artificial Sequence
  synthetic Reed-Solomon code for 8+2 base, 1 base error, 2 nocall correction
gaagggaacg

SEQ ID NO: 162 - DNA, 10 bp, Artificial Sequence
  synthetic Reed-Solomon code for 8+2 base, 1 base error, 2 nocall correction
tcagggaatg

SEQ ID NO: 163 - DNA, 10 bp, Artificial Sequence
  synthetic Reed-Solomon code for 8+2 base, 1 base error, 2 nocall correction
aaggggaaca

SEQ ID NO: 164 - DNA, 10 bp, Artificial Sequence
  synthetic Reed-Solomon code for 8+2 base, 1 base error, 2 nocall correction
taggggaaag

SEQ ID NO: 165 - DNA, 10 bp, Artificial Sequence
  synthetic Reed-Solomon code for 8+2 base, 1 base error, 2 nocall correction
gatgggaaat

SEQ ID NO: 166 - DNA, 10 bp, Artificial Sequence
  synthetic Reed-Solomon code for 8+2 base, 1 base error, 2 nocall correction
gcctggaagc

SEQ ID NO: 167 - DNA, 10 bp, Artificial Sequence
  synthetic Reed-Solomon code for 8+2 base, 1 base error, 2 nocall correction
gtctggaata

SEQ ID NO: 168 - DNA, 10 bp, Artificial Sequence
  synthetic Reed-Solomon code for 8+2 base, 1 base error, 2 nocall correction
ccgtggaagg

SEQ ID NO: 169 - DNA, 10 bp, Artificial Sequence
  synthetic Reed-Solomon code for 8+2 base, 1 base error, 2 nocall correction
ttaatgaatt

SEQ ID NO: 170 - DNA, 10 bp, Artificial Sequence
  synthetic Reed-Solomon code for 8+2 base, 1 base error, 2 nocall correction
tgcatgaatc

SEQ ID NO: 171 - DNA, 10 bp, Artificial Sequence
  synthetic Reed-Solomon code for 8+2 base, 1 base error, 2 nocall correction
actatgaagc

SEQ ID NO: 172 - DNA, 10 bp, Artificial Sequence
  synthetic Reed-Solomon code for 8+2 base, 1 base error, 2 nocall correction
cgtatgaatt

SEQ ID NO: 173 - DNA, 10 bp, Artificial Sequence
  synthetic Reed-Solomon code for 8+2 base, 1 base error, 2 nocall correction
attatgaata

SEQ ID NO: 174 - DNA, 10 bp, Artificial Sequence
  synthetic Reed-Solomon code for 8+2 base, 1 base error, 2 nocall correction
ggactgaaac

SEQ ID NO: 175 - DNA, 10 bp, Artificial Sequence
  synthetic Reed-Solomon code for 8+2 base, 1 base error, 2 nocall correction
gtcctgaaat

SEQ ID NO: 176 - DNA, 10 bp, Artificial Sequence
  synthetic Reed-Solomon code for 8+2 base, 1 base error, 2 nocall correction
tggctgaacc

SEQ ID NO: 177 - DNA, 10 bp, Artificial Sequence
  synthetic Reed-Solomon code for 8+2 base, 1 base error, 2 nocall correction
tccgtgaagc

SEQ ID NO: 178 - DNA, 10 bp, Artificial Sequence
  synthetic Reed-Solomon code for 8+2 base, 1 base error, 2 nocall correction
ttcgtgaata

SEQ ID NO: 179 - DNA, 10 bp, Artificial Sequence
  synthetic Reed-Solomon code for 8+2 base, 1 base error, 2 nocall correction
cctgtgaagt

SEQ ID NO: 180 - DNA, 10 bp, Artificial Sequence
  synthetic Reed-Solomon code for 8+2 base, 1 base error, 2 nocall correction
agtgtgaatc

SEQ ID NO: 181 - DNA, 10 bp, Artificial Sequence
  synthetic Reed-Solomon code for 8+2 base, 1 base error, 2 nocall correction
aaattgaaaa

SEQ ID NO: 182 - DNA, 10 bp, Artificial Sequence
  synthetic Reed-Solomon code for 8+2 base, 1 base error, 2 nocall correction
taattgaacg

SEQ ID NO: 183 - DNA, 10 bp, Artificial Sequence
  synthetic Reed-Solomon code for 8+2 base, 1 base error, 2 nocall correction
gcattgaatg

SEQ ID NO: 184 - DNA, 10 bp, Artificial Sequence
  synthetic Reed-Solomon code for 8+2 base, 1 base error, 2 nocall correction
cacttgaaac

SEQ ID NO: 185 - DNA, 10 bp, Artificial Sequence
  synthetic Reed-Solomon code for 8+2 base, 1 base error, 2 nocall correction
gagttgaaag

SEQ ID NO: 186 - DNA, 10 bp, Artificial Sequence
  synthetic Reed-Solomon code for 8+2 base, 1 base error, 2 nocall correction
acgttgaata

SEQ ID NO: 187 - DNA, 10 bp, Artificial Sequence
  synthetic Reed-Solomon code for 8+2 base, 1 base error, 2 nocall correction
atgttgaagc

SEQ ID NO: 188 - DNA, 10 bp, Artificial Sequence
  synthetic Reed-Solomon code for 8+2 base, 1 base error, 2 nocall correction
tatttgaaat

SEQ ID NO: 189 - DNA, 10 bp, Artificial Sequence
  synthetic Reed-Solomon code for 8+2 base, 1 base error, 2 nocall correction
gctaataaga

SEQ ID NO: 190 - DNA, 10 bp, Artificial Sequence
  synthetic Reed-Solomon code for 8+2 base, 1 base error, 2 nocall correction
gttaataatc

SEQ ID NO: 191 - DNA, 10 bp, Artificial Sequence
  synthetic Reed-Solomon code for 8+2 base, 1 base error, 2 nocall correction
agacataaaa

SEQ ID NO: 192 - DNA, 10 bp, Artificial Sequence
  synthetic Reed-Solomon code for 8+2 base, 1 base error, 2 nocall correction
tgacataacg

SEQ ID NO: 193 - DNA, 10 bp, Artificial Sequence
  synthetic Reed-Solomon code for 8+2 base, 1 base error, 2 nocall correction
ctacataaat

SEQ ID NO: 194 - DNA, 10 bp, Artificial Sequence
  synthetic Reed-Solomon code for 8+2 base, 1 base error, 2 nocall correction
cgccataaac

SEQ ID NO: 195 - DNA, 10 bp, Artificial Sequence
  synthetic Reed-Solomon code for 8+2 base, 1 base error, 2 nocall correction
gggcataaag

SEQ ID NO: 196 - DNA, 10 bp, Artificial Sequence
  synthetic Reed-Solomon code for 8+2 base, 1 base error, 2 nocall correction
tgtcataaat

SEQ ID NO: 197 - DNA, 10 bp, Artificial Sequence
  synthetic Reed-Solomon code for 8+2 base, 1 base error, 2 nocall correction
cttcataacg

SEQ ID NO: 198 - DNA, 10 bp, Artificial Sequence
  synthetic Reed-Solomon code for 8+2 base, 1 base error, 2 nocall correction
ggtgataata

SEQ ID NO: 199 - DNA, 10 bp, Artificial Sequence
  synthetic Reed-Solomon code for 8+2 base, 1 base error, 2 nocall correction
gaatataaac

SEQ ID NO: 200 - DNA, 10 bp, Artificial Sequence
  synthetic Reed-Solomon code for 8+2 base, 1 base error, 2 nocall correction
atatataagg

SEQ ID NO: 201 - DNA, 10 bp, Artificial Sequence
  synthetic Reed-Solomon code for 8+2 base, 1 base error, 2 nocall correction
ccctataatg

SEQ ID NO: 202 - DNA, 10 bp, Artificial Sequence
  synthetic Reed-Solomon code for 8+2 base, 1 base error, 2 nocall correction
tagtataacc

SEQ ID NO: 203 - DNA, 10 bp, Artificial Sequence
  synthetic Reed-Solomon code for 8+2 base, 1 base error, 2 nocall correction
gcgtataatc

SEQ ID NO: 204 - DNA, 10 bp, Artificial Sequence
  synthetic Reed-Solomon code for 8+2 base, 1 base error, 2 nocall correction
gtgtataaga

SEQ ID NO: 205 - DNA, 10 bp, Artificial Sequence
  synthetic Reed-Solomon code for 8+2 base, 1 base error, 2 nocall correction
cgaactaaaa

SEQ ID NO: 206 - DNA, 10 bp, Artificial Sequence
  synthetic Reed-Solomon code for 8+2 base, 1 base error, 2 nocall correction
ataactaaat

SEQ ID NO: 207 - DNA, 10 bp, Artificial Sequence
  synthetic Reed-Solomon code for 8+2 base, 1 base error, 2 nocall correction
agcactaaac

SEQ ID NO: 208 - DNA, 10 bp, Artificial Sequence
  synthetic Reed-Solomon code for 8+2 base, 1 base error, 2 nocall correction
attactaacg

SEQ ID NO: 209 - DNA, 10 bp, Artificial Sequence
  synthetic Reed-Solomon code for 8+2 base, 1 base error, 2 nocall correction
tttactaaaa

SEQ ID NO: 210 - DNA, 10 bp, Artificial Sequence
  synthetic Reed-Solomon code for 8+2 base, 1 base error, 2 nocall correction
ctagctaaac

SEQ ID NO: 211 - DNA, 10 bp, Artificial Sequence
  synthetic Reed-Solomon code for 8+2 base, 1 base error, 2 nocall correction
cgcgctaaat

SEQ ID NO: 212 - DNA, 10 bp, Artificial Sequence
  synthetic Reed-Solomon code for 8+2 base, 1 base error, 2 nocall correction
atcgctaaaa

SEQ ID NO: 213 - DNA, 10 bp, Artificial Sequence
  synthetic Reed-Solomon code for 8+2 base, 1 base error, 2 nocall correction
ttcgctaacg

SEQ ID NO: 214 - DNA, 10 bp, Artificial Sequence
  synthetic Reed-Solomon code for 8+2 base, 1 base error, 2 nocall correction
caggctaaga

SEQ ID NO: 215 - DNA, 10 bp, Artificial Sequence
  synthetic Reed-Solomon code for 8+2 base, 1 base error, 2 nocall correction
tgtgctaaac

SEQ ID NO: 216 - DNA, 10 bp, Artificial Sequence
  synthetic Reed-Solomon code for 8+2 base, 1 base error, 2 nocall correction
taatctaata

SEQ ID NO: 217 - DNA, 10 bp, Artificial Sequence
  synthetic Reed-Solomon code for 8+2 base, 1 base error, 2 nocall correction
gcatctaaca

SEQ ID NO: 218 - DNA, 10 bp, Artificial Sequence
  synthetic Reed-Solomon code for 8+2 base, 1 base error, 2 nocall correction
acgtctaacg

SEQ ID NO: 219 - DNA, 10 bp, Artificial Sequence
  synthetic Reed-Solomon code for 8+2 base, 1 base error, 2 nocall correction
tcgtctaaaa

SEQ ID NO: 220 - DNA, 10 bp, Artificial Sequence
  synthetic Reed-Solomon code for 8+2 base, 1 base error, 2 nocall correction
aattctaatt

SEQ ID NO: 221 - DNA, 10 bp, Artificial Sequence
  synthetic Reed-Solomon code for 8+2 base, 1 base error, 2 nocall correction
tgaagtaatt

SEQ ID NO: 222 - DNA, 10 bp, Artificial Sequence
  synthetic Reed-Solomon code for 8+2 base, 1 base error, 2 nocall correction
tccagtaaga

SEQ ID NO: 223 - DNA, 10 bp, Artificial Sequence
  synthetic Reed-Solomon code for 8+2 base, 1 base error, 2 nocall correction
ttcagtaatc

SEQ ID NO: 224 - DNA, 10 bp, Artificial Sequence
  synthetic Reed-Solomon code for 8+2 base, 1 base error, 2 nocall correction
agtagtaata

SEQ ID NO: 225 - DNA, 10 bp, Artificial Sequence
  synthetic Reed-Solomon code for 8+2 base, 1 base error, 2 nocall correction
cttagtaatt

SEQ ID NO: 226 - DNA, 10 bp, Artificial Sequence
  synthetic Reed-Solomon code for 8+2 base, 1 base error, 2 nocall correction
aaacgtaagg

SEQ ID NO: 227 - DNA, 10 bp, Artificial Sequence
  synthetic Reed-Solomon code for 8+2 base, 1 base error, 2 nocall correction
gtacgtaaac

SEQ ID NO: 228 - DNA, 10 bp, Artificial Sequence
  synthetic Reed-Solomon code for 8+2 base, 1 base error, 2 nocall correction
ggccgtaaat

SEQ ID NO: 229 - DNA, 10 bp, Artificial Sequence
  synthetic Reed-Solomon code for 8+2 base, 1 base error, 2 nocall correction
gagcgtaaga

SEQ ID NO: 230 - DNA, 10 bp, Artificial Sequence
  synthetic Reed-Solomon code for 8+2 base, 1 base error, 2 nocall correction
ttgcgtaacc

SEQ ID NO: 231 - DNA, 10 bp, Artificial Sequence
  synthetic Reed-Solomon code for 8+2 base, 1 base error, 2 nocall correction
tcaggtaagt

SEQ ID NO: 232 - DNA, 10 bp, Artificial Sequence
  synthetic Reed-Solomon code for 8+2 base, 1 base error, 2 nocall correction
tgcggtaata

SEQ ID NO: 233 - DNA, 10 bp, Artificial Sequence
  synthetic Reed-Solomon code for 8+2 base, 1 base error, 2 nocall correction
actggtaaga

SEQ ID NO: 234 - DNA, 10 bp, Artificial Sequence
  synthetic Reed-Solomon code for 8+2 base, 1 base error, 2 nocall correction
attggtaatc

SEQ ID NO: 235 - DNA, 10 bp, Artificial Sequence
  synthetic Reed-Solomon code for 8+2 base, 1 base error, 2 nocall correction
caatgtaaat

SEQ ID NO: 236 - DNA, 10 bp, Artificial Sequence
  synthetic Reed-Solomon code for 8+2 base, 1 base error, 2 nocall correction
ccgtgtaatt

SEQ ID NO: 237 - DNA, 10 bp, Artificial Sequence
  synthetic Reed-Solomon code for 8+2 base, 1 base error, 2 nocall correction
aggtgtaagc

SEQ ID NO: 238 - DNA, 10 bp, Artificial Sequence
  synthetic Reed-Solomon code for 8+2 base, 1 base error, 2 nocall correction
cattgtaacg

SEQ ID NO: 239 - DNA, 10 bp, Artificial Sequence
  synthetic Reed-Solomon code for 8+2 base, 1 base error, 2 nocall correction
ttaattaagg

SEQ ID NO: 240 - DNA, 10 bp, Artificial Sequence
  synthetic Reed-Solomon code for 8+2 base, 1 base error, 2 nocall correction
aagattaacc

SEQ ID NO: 241 - DNA, 10 bp, Artificial Sequence
  synthetic Reed-Solomon code for 8+2 base, 1 base error, 2 nocall correction
cgtattaagg

SEQ ID NO: 242 - DNA, 10 bp, Artificial Sequence
  synthetic Reed-Solomon code for 8+2 base, 1 base error, 2 nocall correction
caacttaata

SEQ ID NO: 243 - DNA, 10 bp, Artificial Sequence
  synthetic Reed-Solomon code for 8+2 base, 1 base error, 2 nocall correction
aaccttaatc

SEQ ID NO: 244 - DNA, 10 bp, Artificial Sequence
  synthetic Reed-Solomon code for 8+2 base, 1 base error, 2 nocall correction
ccgcttaaaa

SEQ ID NO: 245 - DNA, 10 bp, Artificial Sequence
  synthetic Reed-Solomon code for 8+2 base, 1 base error, 2 nocall correction
caggttaact

SEQ ID NO: 246 - DNA, 10 bp, Artificial Sequence
  synthetic Reed-Solomon code for 8+2 base, 1 base error, 2 nocall correction
cctgttaatg

SEQ ID NO: 247 - DNA, 10 bp, Artificial Sequence
  synthetic Reed-Solomon code for 8+2 base, 1 base error, 2 nocall correction
gcatttaagt

SEQ ID NO: 248 - DNA, 10 bp, Artificial Sequence
  synthetic Reed-Solomon code for 8+2 base, 1 base error, 2 nocall correction
ggctttaata

SEQ ID NO: 249 - DNA, 10 bp, Artificial Sequence
  synthetic Reed-Solomon code for 8+2 base, 1 base error, 2 nocall correction
caaaaacaga

SEQ ID NO: 250 - DNA, 10 bp, Artificial Sequence
  synthetic Reed-Solomon code for 8+2 base, 1 base error, 2 nocall correction
aacaaacagc

SEQ ID NO: 251 - DNA, 10 bp, Artificial Sequence
  synthetic Reed-Solomon code for 8+2 base, 1 base error, 2 nocall correction
gtcaaacaag

SEQ ID NO: 252 - DNA, 10 bp, Artificial Sequence
  synthetic Reed-Solomon code for 8+2 base, 1 base error, 2 nocall correction
ctgaaacaac

SEQ ID NO: 253 - DNA, 10 bp, Artificial Sequence
  synthetic Reed-Solomon code for 8+2 base, 1 base error, 2 nocall correction
ggtaaacacc

SEQ ID NO: 254 - DNA, 10 bp, Artificial Sequence
  synthetic Reed-Solomon code for 8+2 base, 1 base error, 2 nocall correction
ttacaacatg

SEQ ID NO: 255 - DNA, 10 bp, Artificial Sequence
  synthetic Reed-Solomon code for 8+2 base, 1 base error, 2 nocall correction
cgtcaacatg

SEQ ID NO: 256 - DNA, 10 bp, Artificial Sequence
  synthetic Reed-Solomon code for 8+2 base, 1 base error, 2 nocall correction
cacgaacagt

SEQ ID NO: 257 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
cgggaacaaa

SEQ ID NO: 258 - DNA, 10 bp, Artificial Sequence
  synthetic Reed-Solomon code for 8+2 base, 1 base error, 2 nocall correction
atggaacaat

SEQ ID NO: 259 - DNA, 10 bp, Artificial Sequence
  synthetic Reed-Solomon code for 8+2 base, 1 base error, 2 nocall correction
tatgaacagc

SEQ ID NO: 260 - DNA, 10 bp, Artificial Sequence
  synthetic Reed-Solomon code for 8+2 base, 1 base error, 2 nocall correction
gttgaacaca

SEQ ID NO: 261 - DNA, 10 bp, Artificial Sequence
  synthetic Reed-Solomon code for 8+2 base, 1 base error, 2 nocall correction
tcctaacaat

SEQ ID NO: 262 - DNA, 10 bp, Artificial Sequence
  synthetic Reed-Solomon code for 8+2 base, 1 base error, 2 nocall correction
ccttaacaac

SEQ ID NO: 263 - DNA, 10 bp, Artificial Sequence
  synthetic Reed-Solomon code for 8+2 base, 1 base error, 2 nocall correction
tccacacagg

SEQ ID NO: 264 - DNA, 10 bp, Artificial Sequence
  synthetic Reed-Solomon code for 8+2 base, 1 base error, 2 nocall correction
agtacacatg

SEQ ID NO: 265 - DNA, 10 bp, Artificial Sequence
  synthetic Reed-Solomon code for 8+2 base, 1 base error, 2 nocall correction
aaaccacaga

SEQ ID NO: 266 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
cacccacagc

SEQ ID NO: 267 - DNA, 10 bp, Artificial Sequence
  synthetic Reed-Solomon code for 8+2 base, 1 base error, 2 nocall correction
gagccacagg

SEQ ID NO: 268 - DNA, 10 bp, Artificial Sequence
  synthetic Reed-Solomon code for 8+2 base, 1 base error, 2 nocall correction
atgccacaac

SEQ ID NO: 269 - DNA, 10 bp, Artificial Sequence
  synthetic Reed-Solomon code for 8+2 base, 1 base error, 2 nocall correction
tatccacagt

SEQ ID NO: 270 - DNA, 10 bp, Artificial Sequence
  synthetic Reed-Solomon code for 8+2 base, 1 base error, 2 nocall correction
tgcgcacatg

SEQ ID NO: 271 - DNA, 10 bp, Artificial Sequence
  synthetic Reed-Solomon code for 8+2 base, 1 base error, 2 nocall correction
actgcacagg

SEQ ID NO: 272 - DNA, 10 bp, Artificial Sequence
  synthetic Reed-Solomon code for 8+2 base, 1 base error, 2 nocall correction
ggatcacagc

SEQ ID NO: 273 - DNA, 10 bp, Artificial Sequence
  synthetic Reed-Solomon code for 8+2 base, 1 base error, 2 nocall correction
gtctcacagt

SEQ ID NO: 274 - DNA, 10 bp, Artificial Sequence
  synthetic Reed-Solomon code for 8+2 base, 1 base error, 2 nocall correction
cattcacaca

SEQ ID NO: 275 - DNA, 10 bp, Artificial Sequence
  synthetic Reed-Solomon code for 8+2 base, 1 base error, 2 nocall correction
cgaagacaag

SEQ ID NO: 276 - DNA, 10 bp, Artificial Sequence
  synthetic Reed-Solomon code for 8+2 base, 1 base error, 2 nocall correction
ttaagacact

SEQ ID NO: 277 - DNA, 10 bp, Artificial Sequence
  synthetic Reed-Solomon code for 8+2 base, 1 base error, 2 nocall correction
tgcagacacc

SEQ ID NO: 278 - DNA, 10 bp, Artificial Sequence
  synthetic Reed-Solomon code for 8+2 base, 1 base error, 2 nocall correction
gtgagacaat

SEQ ID NO: 279 - DNA, 10 bp, Artificial Sequence
  synthetic Reed-Solomon code for 8+2 base, 1 base error, 2 nocall correction
cgtagacact

SEQ ID NO: 280 - DNA, 10 bp, Artificial Sequence
  synthetic Reed-Solomon code for 8+2 base, 1 base error, 2 nocall correction
attagacaca

SEQ ID NO: 281 - DNA, 10 bp, Artificial Sequence
  synthetic Reed-Solomon code for 8+2 base, 1 base error, 2 nocall correction
tttagacaag

SEQ ID NO: 282 - DNA, 10 bp, Artificial Sequence
  synthetic Reed-Solomon code for 8+2 base, 1 base error, 2 nocall correction
tggcgacatc

SEQ ID NO: 283 - DNA, 10 bp, Artificial Sequence
  synthetic Reed-Solomon code for 8+2 base, 1 base error, 2 nocall correction
gacggacagc

SEQ ID NO: 284 - DNA, 10 bp, Artificial Sequence
  synthetic Reed-Solomon code for 8+2 base, 1 base error, 2 nocall correction
atcggacaag

SEQ ID NO: 285 - DNA, 10 bp, Artificial Sequence
  synthetic Reed-Solomon code for 8+2 base, 1 base error, 2 nocall correction
ttcggacaca

SEQ ID NO: 286 - DNA, 10 bp, Artificial Sequence
  synthetic Reed-Solomon code for 8+2 base, 1 base error, 2 nocall correction
cagggacagg

SEQ ID NO: 287 - DNA, 10 bp, Artificial Sequence
  synthetic Reed-Solomon code for 8+2 base, 1 base error, 2 nocall correction
agtggacacc

SEQ ID NO: 288 - DNA, 10 bp, Artificial Sequence
  synthetic Reed-Solomon code for 8+2 base, 1 base error, 2 nocall correction
taatgacatg

SEQ ID NO: 289 - DNA, 10 bp, Artificial Sequence
  synthetic Reed-Solomon code for 8+2 base, 1 base error, 2 nocall correction
gcatgacacg

SEQ ID NO: 290 - DNA, 10 bp, Artificial Sequence
  synthetic Reed-Solomon code for 8+2 base, 1 base error, 2 nocall correction
acgtgacaca

SEQ ID NO: 291 - DNA, 10 bp, Artificial Sequence
  synthetic Reed-Solomon code for 8+2 base, 1 base error, 2 nocall correction
tcgtgacaag

SEQ ID NO: 292 - DNA, 10 bp, Artificial Sequence
  synthetic Reed-Solomon code for 8+2 base, 1 base error, 2 nocall correction
gcttgacaat

SEQ ID NO: 293 - DNA, 10 bp, Artificial Sequence
  synthetic Reed-Solomon code for 8+2 base, 1 base error, 2 nocall correction
accatacaat

SEQ ID NO: 294 - DNA, 10 bp, Artificial Sequence
  synthetic Reed-Solomon code for 8+2 base, 1 base error, 2 nocall correction
aaactacact

SEQ ID NO: 295 - DNA, 10 bp, Artificial Sequence
  synthetic Reed-Solomon code for 8+2 base, 1 base error, 2 nocall correction
aatctacaag

SEQ ID NO: 296 - DNA, 10 bp, Artificial Sequence
  synthetic Reed-Solomon code for 8+2 base, 1 base error, 2 nocall correction
tatctacaca

SEQ ID NO: 297 - DNA, 10 bp, Artificial Sequence
  synthetic Reed-Solomon code for 8+2 base, 1 base error, 2 nocall correction
gctctacata

SEQ ID NO: 298 - DNA, 10 bp, Artificial Sequence
  synthetic Reed-Solomon code for 8+2 base, 1 base error, 2 nocall correction
gttctacagc

SEQ ID NO: 299 - DNA, 10 bp, Artificial Sequence
  synthetic Reed-Solomon code for 8+2 base, 1 base error, 2 nocall correction
gaagtacatg

SEQ ID NO: 300 - DNA, 10 bp, Artificial Sequence
  synthetic Reed-Solomon code for 8+2 base, 1 base error, 2 nocall correction
acagtacaaa

SEQ ID NO: 301 - DNA, 10 bp, Artificial Sequence
  synthetic Reed-Solomon code for 8+2 base, 1 base error, 2 nocall correction
tcagtacacg

SEQ ID NO: 302 - DNA, 10 bp, Artificial Sequence
  synthetic Reed-Solomon code for 8+2 base, 1 base error, 2 nocall correction
cccgtacaac

SEQ ID NO: 303 - DNA, 10 bp, Artificial Sequence
  synthetic Reed-Solomon code for 8+2 base, 1 base error, 2 nocall correction
aaggtacata

SEQ ID NO: 304 - DNA, 10 bp, Artificial Sequence
  synthetic Reed-Solomon code for 8+2 base, 1 base error, 2 nocall correction
gcggtacaag

SEQ ID NO: 305 - DNA, 10 bp, Artificial Sequence
  synthetic Reed-Solomon code for 8+2 base, 1 base error, 2 nocall correction
tctgtacaat

SEQ ID NO: 306 - DNA, 10 bp, Artificial Sequence
  synthetic Reed-Solomon code for 8+2 base, 1 base error, 2 nocall correction
tacttacagc

SEQ ID NO: 307 - DNA, 10 bp, Artificial Sequence
  synthetic Reed-Solomon code for 8+2 base, 1 base error, 2 nocall correction
gtcttacaca

SEQ ID NO: 308 - DNA, 10 bp, Artificial Sequence
  synthetic Reed-Solomon code for 8+2 base, 1 base error, 2 nocall correction
catttacagt

SEQ ID NO: 309 - DNA, 10 bp, Artificial Sequence
  synthetic Reed-Solomon code for 8+2 base, 1 base error, 2 nocall correction
tacaaccagg

SEQ ID NO: 310 - DNA, 10 bp, Artificial Sequence
  synthetic Reed-Solomon code for 8+2 base, 1 base error, 2 nocall correction
aggaaccact

SEQ ID NO: 311 - DNA, 10 bp, Artificial Sequence
  synthetic Reed-Solomon code for 8+2 base, 1 base error, 2 nocall correction
ctgaaccaca

SEQ ID NO: 312 - DNA, 10 bp, Artificial Sequence
  synthetic Reed-Solomon code for 8+2 base, 1 base error, 2 nocall correction
ggtaaccaaa

SEQ ID NO: 313 - DNA, 10 bp, Artificial Sequence
  synthetic Reed-Solomon code for 8+2 base, 1 base error, 2 nocall correction
acacaccaga

SEQ ID NO: 314 - DNA, 10 bp, Artificial Sequence
  synthetic Reed-Solomon code for 8+2 base, 1 base error, 2 nocall correction
atacaccatc

SEQ ID NO: 315 - DNA, 10 bp, Artificial Sequence
  synthetic Reed-Solomon code for 8+2 base, 1 base error, 2 nocall correction
ccccaccagc

SEQ ID NO: 316 - DNA, 10 bp, Artificial Sequence
  synthetic Reed-Solomon code for 8+2 base, 1 base error, 2 nocall correction
agccaccatt

SEQ ID NO: 317 - DNA, 10 bp, Artificial Sequence
  synthetic Reed-Solomon code for 8+2 base, 1 base error, 2 nocall correction
ctccaccata

SEQ ID NO: 318 - DNA, 10 bp, Artificial Sequence
  synthetic Reed-Solomon code for 8+2 base, 1 base error, 2 nocall correction
gcgcaccagg

SEQ ID NO: 319 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
tctcaccagt

SEQ ID NO: 320 - DNA, 10 bp, Artificial Sequence
  synthetic Reed-Solomon code for 8+2 base, 1 base error, 2 nocall correction
ggcgaccacg

SEQ ID NO: 321 - DNA, 10 bp, Artificial Sequence
  synthetic Reed-Solomon code for 8+2 base, 1 base error, 2 nocall correction
cgggaccacc

SEQ ID NO: 322 - DNA, 10 bp, Artificial Sequence
  synthetic Reed-Solomon code for 8+2 base, 1 base error, 2 nocall correction
aatgaccagg

SEQ ID NO: 323 - DNA, 10 bp, Artificial Sequence
  synthetic Reed-Solomon code for 8+2 base, 1 base error, 2 nocall correction
gttgaccaac

SEQ ID NO: 324 - DNA, 10 bp, Artificial Sequence
  synthetic Reed-Solomon code for 8+2 base, 1 base error, 2 nocall correction
ccttaccaca

SEQ ID NO: 325 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
ccaacccaga

SEQ ID NO: 326 - DNA, 10 bp, Artificial Sequence
  synthetic Reed-Solomon code for 8+2 base, 1 base error, 2 nocall correction
ctaacccatc

SEQ ID NO: 327 - DNA, 10 bp, Artificial Sequence
  synthetic Reed-Solomon code for 8+2 base, 1 base error, 2 nocall correction
accacccagc

SEQ ID NO: 328 - DNA, 10 bp, Artificial Sequence
  synthetic Reed-Solomon code for 8+2 base, 1 base error, 2 nocall correction
cgcacccatt

SEQ ID NO: 329 - DNA, 10 bp, Artificial Sequence
  synthetic Reed-Solomon code for 8+2 base, 1 base error, 2 nocall correction
atcacccata

SEQ ID NO: 330 - DNA, 10 bp, Artificial Sequence
  synthetic Reed-Solomon code for 8+2 base, 1 base error, 2 nocall correction
tgtacccatc

SEQ ID NO: 331 - DNA, 10 bp, Artificial Sequence
  synthetic Reed-Solomon code for 8+2 base, 1 base error, 2 nocall correction
gtaccccacg

SEQ ID NO: 332 - DNA, 10 bp, Artificial Sequence
  synthetic Reed-Solomon code for 8+2 base, 1 base error, 2 nocall correction
cggccccact

SEQ ID NO: 333 - DNA, 10 bp, Artificial Sequence
  synthetic Reed-Solomon code for 8+2 base, 1 base error, 2 nocall correction
atgccccaca

SEQ ID NO: 334 - DNA, 10 bp, Artificial Sequence
  synthetic Reed-Solomon code for 8+2 base, 1 base error, 2 nocall correction
ttgccccaag

SEQ ID NO: 335 - DNA, 10 bp, Artificial Sequence
  synthetic Reed-Solomon code for 8+2 base, 1 base error, 2 nocall correction
gttccccaat

SEQ ID NO: 336 - DNA, 10 bp, Artificial Sequence
  synthetic Reed-Solomon code for 8+2 base, 1 base error, 2 nocall correction
cgagcccata

SEQ ID NO: 337 - DNA, 10 bp, Artificial Sequence
  synthetic Reed-Solomon code for 8+2 base, 1 base error, 2 nocall correction
atagcccatt

SEQ ID NO: 338 - DNA, 10 bp, Artificial Sequence
  synthetic Reed-Solomon code for 8+2 base, 1 base error, 2 nocall correction
cccgcccagt

SEQ ID NO: 339 - DNA, 10 bp, Artificial Sequence
  synthetic Reed-Solomon code for 8+2 base, 1 base error, 2 nocall correction
agcgcccatc

SEQ ID NO: 340 - DNA, 10 bp, Artificial Sequence
  synthetic Reed-Solomon code for 8+2 base, 1 base error, 2 nocall correction
tctgcccagc

SEQ ID NO: 341 - DNA, 10 bp, Artificial Sequence
  synthetic Reed-Solomon code for 8+2 base, 1 base error, 2 nocall correction
tttgcccata

SEQ ID NO: 342 - DNA, 10 bp, Artificial Sequence
  synthetic Reed-Solomon code for 8+2 base, 1 base error, 2 nocall correction
tactcccaat

SEQ ID NO: 343 - DNA, 10 bp, Artificial Sequence
  synthetic Reed-Solomon code for 8+2 base, 1 base error, 2 nocall correction
tggtcccaga

SEQ ID NO: 344 - DNA, 10 bp, Artificial Sequence
  synthetic Reed-Solomon code for 8+2 base, 1 base error, 2 nocall correction
cattcccaac

SEQ ID NO: 345 - DNA, 10 bp, Artificial Sequence
  synthetic Reed-Solomon code for 8+2 base, 1 base error, 2 nocall correction
agcagccacg

SEQ ID NO: 346 - DNA, 10 bp, Artificial Sequence
  synthetic Reed-Solomon code for 8+2 base, 1 base error, 2 nocall correction
tgcagccaaa

SEQ ID NO: 347 - DNA, 10 bp, Artificial Sequence
  synthetic Reed-Solomon code for 8+2 base, 1 base error, 2 nocall correction
tagagccagt

SEQ ID NO: 348 - DNA, 10 bp, Artificial Sequence
  synthetic Reed-Solomon code for 8+2 base, 1 base error, 2 nocall correction
gatagccagg

SEQ ID NO: 349 - DNA, 10 bp, Artificial Sequence
  synthetic Reed-Solomon code for 8+2 base, 1 base error, 2 nocall correction
attagccaac

SEQ ID NO: 350 - DNA, 10 bp, Artificial Sequence
  synthetic Reed-Solomon code for 8+2 base, 1 base error, 2 nocall correction
ggacgccata

SEQ ID NO: 351 - DNA, 10 bp, Artificial Sequence
  synthetic Reed-Solomon code for 8+2 base, 1 base error, 2 nocall correction
gcccgccagt

SEQ ID NO: 352 - DNA, 10 bp, Artificial Sequence
  synthetic Reed-Solomon code for 8+2 base, 1 base error, 2 nocall correction
aggcgccatg

SEQ ID NO: 353 - DNA, 10 bp, Artificial Sequence
  synthetic Reed-Solomon code for 8+2 base, 1 base error, 2 nocall correction
tgaggccaat

SEQ ID NO: 354 - DNA, 10 bp, Artificial Sequence
  synthetic Reed-Solomon code for 8+2 base, 1 base error, 2 nocall correction
ctaggccacg

SEQ ID NO: 355 - DNA, 10 bp, Artificial Sequence
  synthetic Reed-Solomon code for 8+2 base, 1 base error, 2 nocall correction
ttcggccaac

SEQ ID NO: 356 - DNA, 10 bp, Artificial Sequence
  synthetic Reed-Solomon code for 8+2 base, 1 base error, 2 nocall correction
gggggccact

SEQ ID NO: 357 - DNA, 10 bp, Artificial Sequence
  synthetic Reed-Solomon code for 8+2 base, 1 base error, 2 nocall correction
agtggccaaa

SEQ ID NO: 358 - DNA, 10 bp, Artificial Sequence
  synthetic Reed-Solomon code for 8+2 base, 1 base error, 2 nocall correction
tgtggccacg

SEQ ID NO: 359 - DNA, 10 bp, Artificial Sequence
  synthetic Reed-Solomon code for 8+2 base, 1 base error, 2 nocall correction
cttggccaat

SEQ ID NO: 360 - DNA, 10 bp, Artificial Sequence
  synthetic Reed-Solomon code for 8+2 base, 1 base error, 2 nocall correction
aaatgccatc

SEQ ID NO: 361 - DNA, 10 bp, Artificial Sequence
  synthetic Reed-Solomon code for 8+2 base, 1 base error, 2 nocall correction
cactgccata

SEQ ID NO: 362 - DNA, 10 bp, Artificial Sequence
  synthetic Reed-Solomon code for 8+2 base, 1 base error, 2 nocall correction
acgtgccaac

SEQ ID NO: 363 - DNA, 10 bp, Artificial Sequence
  synthetic Reed-Solomon code for 8+2 base, 1 base error, 2 nocall correction
ccaatccact

SEQ ID NO: 364 - DNA, 10 bp, Artificial Sequence
  synthetic Reed-Solomon code for 8+2 base, 1 base error, 2 nocall correction
cctatccaag

SEQ ID NO: 365 - DNA, 10 bp, Artificial Sequence
  synthetic Reed-Solomon code for 8+2 base, 1 base error, 2 nocall correction
cacctccaat

SEQ ID NO: 366 - DNA, 10 bp, Artificial Sequence
  synthetic Reed-Solomon code for 8+2 base, 1 base error, 2 nocall correction
cggctccaga

SEQ ID NO: 367 - DNA, 10 bp, Artificial Sequence
  synthetic Reed-Solomon code for 8+2 base, 1 base error, 2 nocall correction
atgctccagt

SEQ ID NO: 368 - DNA, 10 bp, Artificial Sequence
  synthetic Reed-Solomon code for 8+2 base, 1 base error, 2 nocall correction
tatctccaac

SEQ ID NO: 369 - DNA, 10 bp, Artificial Sequence
  synthetic Reed-Solomon code for 8+2 base, 1 base error, 2 nocall correction
acagtccacc

SEQ ID NO: 370 - DNA, 10 bp, Artificial Sequence
  synthetic Reed-Solomon code for 8+2 base, 1 base error, 2 nocall correction
cccgtccaca

SEQ ID NO: 371 - DNA, 10 bp, Artificial Sequence
  synthetic Reed-Solomon code for 8+2 base, 1 base error, 2 nocall correction
ggattccaat

SEQ ID NO: 372 - DNA, 10 bp, Artificial Sequence
  synthetic Reed-Solomon code for 8+2 base, 1 base error, 2 nocall correction
aacttccagg

SEQ ID NO: 373 - DNA, 10 bp, Artificial Sequence
  synthetic Reed-Solomon code for 8+2 base, 1 base error, 2 nocall correction
gtcttccaac

SEQ ID NO: 374 - DNA, 10 bp, Artificial Sequence
  synthetic Reed-Solomon code for 8+2 base, 1 base error, 2 nocall correction
tggttccact

SEQ ID NO: 375 - DNA, 10 bp, Artificial Sequence
  synthetic Reed-Solomon code for 8+2 base, 1 base error, 2 nocall correction
ctgttccaag

SEQ ID NO: 376 - DNA, 10 bp, Artificial Sequence
  synthetic Reed-Solomon code for 8+2 base, 1 base error, 2 nocall correction
ggtttccacg

SEQ ID NO: 377 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
caaaagcaag

SEQ ID NO: 378 - DNA, 10 bp, Artificial Sequence
  synthetic Reed-Solomon code for 8+2 base, 1 base error, 2 nocall correction
tacaagcacc

SEQ ID NO: 379 - DNA, 10 bp, Artificial Sequence
  synthetic Reed-Solomon code for 8+2 base, 1 base error, 2 nocall correction
gccaagcatc

SEQ ID NO: 380 - DNA, 10 bp, Artificial Sequence
  synthetic Reed-Solomon code for 8+2 base, 1 base error, 2 nocall correction
gtcaagcaga

SEQ ID NO: 381 - DNA, 10 bp, Artificial Sequence
  synthetic Reed-Solomon code for 8+2 base, 1 base error, 2 nocall correction
ccgaagcatg

SEQ ID NO: 382 - DNA, 10 bp, Artificial Sequence
  synthetic Reed-Solomon code for 8+2 base, 1 base error, 2 nocall correction
cataagcact

SEQ ID NO: 383 - DNA, 10 bp, Artificial Sequence
  synthetic Reed-Solomon code for 8+2 base, 1 base error, 2 nocall correction
tcacagcaac

SEQ ID NO: 384 - DNA, 10 bp, Artificial Sequence
  synthetic Reed-Solomon code for 8+2 base, 1 base error, 2 nocall correction
ccccagcacg

SEQ ID NO: 385 - DNA, 10 bp, Artificial Sequence
  synthetic Reed-Solomon code for 8+2 base, 1 base error, 2 nocall correction
tagcagcatc

SEQ ID NO: 386 - DNA, 10 bp, Artificial Sequence
  synthetic Reed-Solomon code for 8+2 base, 1 base error, 2 nocall correction
gcgcagcacc

SEQ ID NO: 387 - DNA, 10 bp, Artificial Sequence
  synthetic Reed-Solomon code for 8+2 base, 1 base error, 2 nocall correction
gtagagcagt

SEQ ID NO: 388 - DNA, 10 bp, Artificial Sequence
  synthetic Reed-Solomon code for 8+2 base, 1 base error, 2 nocall correction
ggcgagcagc

SEQ ID NO: 389 - DNA, 10 bp, Artificial Sequence
  synthetic Reed-Solomon code for 8+2 base, 1 base error, 2 nocall correction
cgggagcagg

SEQ ID NO: 390 - DNA, 10 bp, Artificial Sequence
  synthetic Reed-Solomon code for 8+2 base, 1 base error, 2 nocall correction
aatgagcacc

SEQ ID NO: 391 - DNA, 10 bp, Artificial Sequence
  synthetic Reed-Solomon code for 8+2 base, 1 base error, 2 nocall correction
tgatagcatg

SEQ ID NO: 392 - DNA, 10 bp, Artificial Sequence
  synthetic Reed-Solomon code for 8+2 base, 1 base error, 2 nocall correction
ctttagcatg

SEQ ID NO: 393 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
accacgcacg

SEQ ID NO: 394 - DNA, 10 bp, Artificial Sequence
  synthetic Reed-Solomon code for 8+2 base, 1 base error, 2 nocall correction
tccacgcaaa

SEQ ID NO: 395 - DNA, 10 bp, Artificial Sequence
  synthetic Reed-Solomon code for 8+2 base, 1 base error, 2 nocall correction
aaaccgcaag

SEQ ID NO: 396 - DNA, 10 bp, Artificial Sequence
  synthetic Reed-Solomon code for 8+2 base, 1 base error, 2 nocall correction
taaccgcaca

SEQ ID NO: 397 - DNA, 10 bp, Artificial Sequence
  synthetic Reed-Solomon code for 8+2 base, 1 base error, 2 nocall correction
gcaccgcata

SEQ ID NO: 398 - DNA, 10 bp, Artificial Sequence
  synthetic Reed-Solomon code for 8+2 base, 1 base error, 2 nocall correction
gtaccgcagc

SEQ ID NO: 399 - DNA, 10 bp, Artificial Sequence
  synthetic Reed-Solomon code for 8+2 base, 1 base error, 2 nocall correction
ggcccgcagt

SEQ ID NO: 400 - DNA, 10 bp, Artificial Sequence
  synthetic Reed-Solomon code for 8+2 base, 1 base error, 2 nocall correction
gagccgcaaa

SEQ ID NO: 401 - DNA, 10 bp, Artificial Sequence
  synthetic Reed-Solomon code for 8+2 base, 1 base error, 2 nocall correction
acgccgcatg

SEQ ID NO: 402 - DNA, 10 bp, Artificial Sequence
  synthetic Reed-Solomon code for 8+2 base, 1 base error, 2 nocall correction
aatccgcact

SEQ ID NO: 403 - DNA, 10 bp, Artificial Sequence
  synthetic Reed-Solomon code for 8+2 base, 1 base error, 2 nocall correction
tcagcgcaat

SEQ ID NO: 404 - DNA, 10 bp, Artificial Sequence
  synthetic Reed-Solomon code for 8+2 base, 1 base error, 2 nocall correction
taggcgcatt

SEQ ID NO: 405 - DNA, 10 bp, Artificial Sequence
  synthetic Reed-Solomon code for 8+2 base, 1 base error, 2 nocall correction
gcggcgcact

SEQ ID NO: 406 - DNA, 10 bp, Artificial Sequence
  synthetic Reed-Solomon code for 8+2 base, 1 base error, 2 nocall correction
gatgcgcatg

SEQ ID NO: 407 - DNA, 10 bp, Artificial Sequence
  synthetic Reed-Solomon code for 8+2 base, 1 base error, 2 nocall correction
actgcgcaaa

SEQ ID NO: 408 - DNA, 10 bp, Artificial Sequence
  synthetic Reed-Solomon code for 8+2 base, 1 base error, 2 nocall correction
tctgcgcacg

SEQ ID NO: 409 - DNA, 10 bp, Artificial Sequence
  synthetic Reed-Solomon code for 8+2 base, 1 base error, 2 nocall correction
caatcgcagt

SEQ ID NO: 410 - DNA, 10 bp, Artificial Sequence
  synthetic Reed-Solomon code for 8+2 base, 1 base error, 2 nocall correction
aggtcgcaac

SEQ ID NO: 411 - DNA, 10 bp, Artificial Sequence
  synthetic Reed-Solomon code for 8+2 base, 1 base error, 2 nocall correction
cgaaggcaga

SEQ ID NO: 412 - DNA, 10 bp, Artificial Sequence
  synthetic Reed-Solomon code for 8+2 base, 1 base error, 2 nocall correction
ataaggcagt

SEQ ID NO: 413 - DNA, 10 bp, Artificial Sequence
  synthetic Reed-Solomon code for 8+2 base, 1 base error, 2 nocall correction
cccaggcatt

SEQ ID NO: 414 - DNA, 10 bp, Artificial Sequence
  synthetic Reed-Solomon code for 8+2 base, 1 base error, 2 nocall correction
agcaggcagc

SEQ ID NO: 415 - DNA, 10 bp, Artificial Sequence
  synthetic Reed-Solomon code for 8+2 base, 1 base error, 2 nocall correction
gataggcacc

SEQ ID NO: 416 - DNA, 10 bp, Artificial Sequence
  synthetic Reed-Solomon code for 8+2 base, 1 base error, 2 nocall correction
tctaggcatc

SEQ ID NO: 417 - DNA, 10 bp, Artificial Sequence
  synthetic Reed-Solomon code for 8+2 base, 1 base error, 2 nocall correction
tttaggcaga

SEQ ID NO: 418 - DNA, 10 bp, Artificial Sequence
  synthetic Reed-Solomon code for 8+2 base, 1 base error, 2 nocall correction
ccgcggcact

SEQ ID NO: 419 - DNA, 10 bp, Artificial Sequence
  synthetic Reed-Solomon code for 8+2 base, 1 base error, 2 nocall correction
catcggcatg

SEQ ID NO: 420 - DNA, 10 bp, Artificial Sequence
  synthetic Reed-Solomon code for 8+2 base, 1 base error, 2 nocall correction
ccagggcata

SEQ ID NO: 421 - DNA, 10 bp, Artificial Sequence
  synthetic Reed-Solomon code for 8+2 base, 1 base error, 2 nocall correction
ctagggcagc

SEQ ID NO: 422 - DNA, 10 bp, Artificial Sequence
  synthetic Reed-Solomon code for 8+2 base, 1 base error, 2 nocall correction
accgggcatc

SEQ ID NO: 423 - DNA, 10 bp, Artificial Sequence
  synthetic Reed-Solomon code for 8+2 base, 1 base error, 2 nocall correction
cgcgggcagt

SEQ ID NO: 424 - DNA, 10 bp, Artificial Sequence
  synthetic Reed-Solomon code for 8+2 base, 1 base error, 2 nocall correction
atcgggcaga

SEQ ID NO: 425 - DNA, 10 bp, Artificial Sequence
  synthetic Reed-Solomon code for 8+2 base, 1 base error, 2 nocall correction
caggggcaaa

SEQ ID NO: 426 - DNA, 10 bp, Artificial Sequence
  synthetic Reed-Solomon code for 8+2 base, 1 base error, 2 nocall correction
tgtgggcagc

SEQ ID NO: 427 - DNA, 10 bp, Artificial Sequence
  synthetic Reed-Solomon code for 8+2 base, 1 base error, 2 nocall correction
tcgtggcaga

SEQ ID NO: 428 - DNA, 10 bp, Artificial Sequence
  synthetic Reed-Solomon code for 8+2 base, 1 base error, 2 nocall correction
ttgtggcatc

SEQ ID NO: 429 - DNA, 10 bp, Artificial Sequence
  synthetic Reed-Solomon code for 8+2 base, 1 base error, 2 nocall correction
agaatgcatg

SEQ ID NO: 430 - DNA, 10 bp, Artificial Sequence
  synthetic Reed-Solomon code for 8+2 base, 1 base error, 2 nocall correction
gggatgcata

SEQ ID NO: 431 - DNA, 10 bp, Artificial Sequence
  synthetic Reed-Solomon code for 8+2 base, 1 base error, 2 nocall correction
taactgcagt

SEQ ID NO: 432 - DNA, 10 bp, Artificial Sequence
  synthetic Reed-Solomon code for 8+2 base, 1 base error, 2 nocall correction
ggcctgcaca

SEQ ID NO: 433 - DNA, 10 bp, Artificial Sequence
  synthetic Reed-Solomon code for 8+2 base, 1 base error, 2 nocall correction
aatctgcaga

SEQ ID NO: 434 - DNA, 10 bp, Artificial Sequence
  synthetic Reed-Solomon code for 8+2 base, 1 base error, 2 nocall correction
acagtgcagg

SEQ ID NO: 435 - DNA, 10 bp, Artificial Sequence
  synthetic Reed-Solomon code for 8+2 base, 1 base error, 2 nocall correction
ctcgtgcatg

SEQ ID NO: 436 - DNA, 10 bp, Artificial Sequence
  synthetic Reed-Solomon code for 8+2 base, 1 base error, 2 nocall correction
gcggtgcaga

SEQ ID NO: 437 - DNA, 10 bp, Artificial Sequence
  synthetic Reed-Solomon code for 8+2 base, 1 base error, 2 nocall correction
gtggtgcatc

SEQ ID NO: 438 - DNA, 10 bp, Artificial Sequence
  synthetic Reed-Solomon code for 8+2 base, 1 base error, 2 nocall correction
caattgcaca

SEQ ID NO: 439 - DNA, 10 bp, Artificial Sequence
  synthetic Reed-Solomon code for 8+2 base, 1 base error, 2 nocall correction
aacttgcacc

SEQ ID NO: 440 - DNA, 10 bp, Artificial Sequence
  synthetic Reed-Solomon code for 8+2 base, 1 base error, 2 nocall correction
ggtttgcagc

SEQ ID NO: 441 - DNA, 10 bp, Artificial Sequence
  synthetic Reed-Solomon code for 8+2 base, 1 base error, 2 nocall correction
ccgaatcagt

SEQ ID NO: 442 - DNA, 10 bp, Artificial Sequence
  synthetic Reed-Solomon code for 8+2 base, 1 base error, 2 nocall correction
aggaatcatc

SEQ ID NO: 443 - DNA, 10 bp, Artificial Sequence
  synthetic Reed-Solomon code for 8+2 base, 1 base error, 2 nocall correction
cgacatcaca

SEQ ID NO: 444 - DNA, 10 bp, Artificial Sequence
  synthetic Reed-Solomon code for 8+2 base, 1 base error, 2 nocall correction
atacatcact

SEQ ID NO: 445 - DNA, 10 bp, Artificial Sequence
  synthetic Reed-Solomon code for 8+2 base, 1 base error, 2 nocall correction
agccatcacc

SEQ ID NO: 446 - DNA, 10 bp, Artificial Sequence
  synthetic Reed-Solomon code for 8+2 base, 1 base error, 2 nocall correction
gatcatcagc

SEQ ID NO: 447 - DNA, 10 bp, Artificial Sequence
  synthetic Reed-Solomon code for 8+2 base, 1 base error, 2 nocall correction
attcatcaag

SEQ ID NO: 448 - DNA, 10 bp, Artificial Sequence
  synthetic Reed-Solomon code for 8+2 base, 1 base error, 2 nocall correction
tttcatcaca

SEQ ID NO: 449 - DNA, 10 bp, Artificial Sequence
  synthetic Reed-Solomon code for 8+2 base, 1 base error, 2 nocall correction
gtagatcatg

SEQ ID NO: 450 - DNA, 10 bp, Artificial Sequence
  synthetic Reed-Solomon code for 8+2 base, 1 base error, 2 nocall correction
acggatcagc

SEQ ID NO: 451 - DNA, 10 bp, Artificial Sequence
  synthetic Reed-Solomon code for 8+2 base, 1 base error, 2 nocall correction
cgggatcatt

SEQ ID NO: 452 - DNA, 10 bp, Artificial Sequence
  synthetic Reed-Solomon code for 8+2 base, 1 base error, 2 nocall correction
atggatcata

SEQ ID NO: 453 - DNA, 10 bp, Artificial Sequence
  synthetic Reed-Solomon code for 8+2 base, 1 base error, 2 nocall correction
tgatatcagt

SEQ ID NO: 454 - DNA, 10 bp, Artificial Sequence
  synthetic Reed-Solomon code for 8+2 base, 1 base error, 2 nocall correction
gactatcaca

SEQ ID NO: 455 - DNA, 10 bp, Artificial Sequence
  synthetic Reed-Solomon code for 8+2 base, 1 base error, 2 nocall correction
tcctatcata

SEQ ID NO: 456 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
ttctatcagc

SEQ ID NO: 457 - DNA, 10 bp, Artificial Sequence
  synthetic Reed-Solomon code for 8+2 base, 1 base error, 2 nocall correction
agttatcaga

SEQ ID NO: 458 - DNA, 10 bp, Artificial Sequence
  synthetic Reed-Solomon code for 8+2 base, 1 base error, 2 nocall correction
ctttatcagt

SEQ ID NO: 459 - DNA, 10 bp, Artificial Sequence
  synthetic Reed-Solomon code for 8+2 base, 1 base error, 2 nocall correction
agaactcaca

SEQ ID NO: 460 - DNA, 10 bp, Artificial Sequence
  synthetic Reed-Solomon code for 8+2 base, 1 base error, 2 nocall correction
tgaactcaag

SEQ ID NO: 461 - DNA, 10 bp, Artificial Sequence
  synthetic Reed-Solomon code for 8+2 base, 1 base error, 2 nocall correction
ctaactcact

SEQ ID NO: 462 - DNA, 10 bp, Artificial Sequence
  synthetic Reed-Solomon code for 8+2 base, 1 base error, 2 nocall correction
cgcactcacc

SEQ ID NO: 463 - DNA, 10 bp, Artificial Sequence
  synthetic Reed-Solomon code for 8+2 base, 1 base error, 2 nocall correction
gggactcacg

SEQ ID NO: 464 - DNA, 10 bp, Artificial Sequence
  synthetic Reed-Solomon code for 8+2 base, 1 base error, 2 nocall correction
tgtactcact

SEQ ID NO: 465 - DNA, 10 bp, Artificial Sequence
  synthetic Reed-Solomon code for 8+2 base, 1 base error, 2 nocall correction
cttactcaag

SEQ ID NO: 466 - DNA, 10 bp, Artificial Sequence
  synthetic Reed-Solomon code for 8+2 base, 1 base error, 2 nocall correction
ggccctcatg

SEQ ID NO: 467 - DNA, 10 bp, Artificial Sequence
  synthetic Reed-Solomon code for 8+2 base, 1 base error, 2 nocall correction
acgcctcagt

SEQ ID NO: 468 - DNA, 10 bp, Artificial Sequence
  synthetic Reed-Solomon code for 8+2 base, 1 base error, 2 nocall correction
cggcctcatc

SEQ ID NO: 469 - DNA, 10 bp, Artificial Sequence
  synthetic Reed-Solomon code for 8+2 base, 1 base error, 2 nocall correction
atagctcacc

SEQ ID NO: 470 - DNA, 10 bp, Artificial Sequence
  synthetic Reed-Solomon code for 8+2 base, 1 base error, 2 nocall correction
agcgctcact

SEQ ID NO: 471 - DNA, 10 bp, Artificial Sequence
  synthetic Reed-Solomon code for 8+2 base, 1 base error, 2 nocall correction
ctcgctcaca

SEQ ID NO: 472 - DNA, 10 bp, Artificial Sequence
  synthetic Reed-Solomon code for 8+2 base, 1 base error, 2 nocall correction
taggctcagg

SEQ ID NO: 473 - DNA, 10 bp, Artificial Sequence
  synthetic Reed-Solomon code for 8+2 base, 1 base error, 2 nocall correction
gatgctcagt

SEQ ID NO: 474 - DNA, 10 bp, Artificial Sequence
  synthetic Reed-Solomon code for 8+2 base, 1 base error, 2 nocall correction
caatctcatg

SEQ ID NO: 475 - DNA, 10 bp, Artificial Sequence
  synthetic Reed-Solomon code for 8+2 base, 1 base error, 2 nocall correction
gcctctcaac

SEQ ID NO: 476 - DNA, 10 bp, Artificial Sequence
  synthetic Reed-Solomon code for 8+2 base, 1 base error, 2 nocall correction
ccgtctcaag

SEQ ID NO: 477 - DNA, 10 bp, Artificial Sequence
  synthetic Reed-Solomon code for 8+2 base, 1 base error, 2 nocall correction
ataagtcatg

SEQ ID NO: 478 - DNA, 10 bp, Artificial Sequence
  synthetic Reed-Solomon code for 8+2 base, 1 base error, 2 nocall correction
cccagtcagg

SEQ ID NO: 479 - DNA, 10 bp, Artificial Sequence
  synthetic Reed-Solomon code for 8+2 base, 1 base error, 2 nocall correction
gcgagtcagc

SEQ ID NO: 480 - DNA, 10 bp, Artificial Sequence
  synthetic Reed-Solomon code for 8+2 base, 1 base error, 2 nocall correction
gtgagtcata

SEQ ID NO: 481 - DNA, 10 bp, Artificial Sequence
  synthetic Reed-Solomon code for 8+2 base, 1 base error, 2 nocall correction
taccgtcagc

SEQ ID NO: 482 - DNA, 10 bp, Artificial Sequence
  synthetic Reed-Solomon code for 8+2 base, 1 base error, 2 nocall correction
gtccgtcaca

SEQ ID NO: 483 - DNA, 10 bp, Artificial Sequence
  synthetic Reed-Solomon code for 8+2 base, 1 base error, 2 nocall correction
catcgtcagt

SEQ ID NO: 484 - DNA, 10 bp, Artificial Sequence
  synthetic Reed-Solomon code for 8+2 base, 1 base error, 2 nocall correction
cgcggtcatg

SEQ ID NO: 485 - DNA, 10 bp, Artificial Sequence
  synthetic Reed-Solomon code for 8+2 base, 1 base error, 2 nocall correction
gggggtcatc

SEQ ID NO: 486 - DNA, 10 bp, Artificial Sequence
  synthetic Reed-Solomon code for 8+2 base, 1 base error, 2 nocall correction
aaatgtcact

SEQ ID NO: 487 - DNA, 10 bp, Artificial Sequence
  synthetic Reed-Solomon code for 8+2 base, 1 base error, 2 nocall correction
aattgtcaag

SEQ ID NO: 488 - DNA, 10 bp, Artificial Sequence
  synthetic Reed-Solomon code for 8+2 base, 1 base error, 2 nocall correction
tattgtcaca

SEQ ID NO: 489 - DNA, 10 bp, Artificial Sequence
  synthetic Reed-Solomon code for 8+2 base, 1 base error, 2 nocall correction
gcttgtcata

SEQ ID NO: 490 - DNA, 10 bp, Artificial Sequence
  synthetic Reed-Solomon code for 8+2 base, 1 base error, 2 nocall correction
gtttgtcagc

SEQ ID NO: 491 - DNA, 10 bp, Artificial Sequence
  synthetic Reed-Solomon code for 8+2 base, 1 base error, 2 nocall correction
ccaattcatc

SEQ ID NO: 492 - DNA, 10 bp, Artificial Sequence
  synthetic Reed-Solomon code for 8+2 base, 1 base error, 2 nocall correction
agaattcagt

SEQ ID NO: 493 - DNA, 10 bp, Artificial Sequence
  synthetic Reed-Solomon code for 8+2 base, 1 base error, 2 nocall correction
ctaattcaga

SEQ ID NO: 494 - DNA, 10 bp, Artificial Sequence
  synthetic Reed-Solomon code for 8+2 base, 1 base error, 2 nocall correction
gacattcaag

SEQ ID NO: 495 - DNA, 10 bp, Artificial Sequence
  synthetic Reed-Solomon code for 8+2 base, 1 base error, 2 nocall correction
accattcata

SEQ ID NO: 496 - DNA, 10 bp, Artificial Sequence
  synthetic Reed-Solomon code for 8+2 base, 1 base error, 2 nocall correction
atcattcagc

SEQ ID NO: 497 - DNA, 10 bp, Artificial Sequence
  synthetic Reed-Solomon code for 8+2 base, 1 base error, 2 nocall correction
cagattcaac

SEQ ID NO: 498 - DNA, 10 bp, Artificial Sequence
  synthetic Reed-Solomon code for 8+2 base, 1 base error, 2 nocall correction
tgtattcaga

SEQ ID NO: 499 - DNA, 10 bp, Artificial Sequence
  synthetic Reed-Solomon code for 8+2 base, 1 base error, 2 nocall correction
taacttcatg

SEQ ID NO: 500 - DNA, 10 bp, Artificial Sequence
  synthetic Reed-Solomon code for 8+2 base, 1 base error, 2 nocall correction
gcacttcacg

SEQ ID NO: 501 - DNA, 10 bp, Artificial Sequence
  synthetic Reed-Solomon code for 8+2 base, 1 base error, 2 nocall correction
acgcttcaca

SEQ ID NO: 502 - DNA, 10 bp, Artificial Sequence
  synthetic Reed-Solomon code for 8+2 base, 1 base error, 2 nocall correction
tcgcttcaag

SEQ ID NO: 503 - DNA, 10 bp, Artificial Sequence
  synthetic Reed-Solomon code for 8+2 base, 1 base error, 2 nocall correction
gctcttcaat

SEQ ID NO: 504 - DNA, 10 bp, Artificial Sequence
  synthetic Reed-Solomon code for 8+2 base, 1 base error, 2 nocall correction
acagttcatt

SEQ ID NO: 505 - DNA, 10 bp, Artificial Sequence
  synthetic Reed-Solomon code for 8+2 base, 1 base error, 2 nocall correction
cgagttcagc

SEQ ID NO: 506 - DNA, 10 bp, Artificial Sequence
  synthetic Reed-Solomon code for 8+2 base, 1 base error, 2 nocall correction
agcgttcaga

SEQ ID NO: 507 - DNA, 10 bp, Artificial Sequence
  synthetic Reed-Solomon code for 8+2 base, 1 base error, 2 nocall correction
ctcgttcagt

SEQ ID NO: 508 - DNA, 10 bp, Artificial Sequence
  synthetic Reed-Solomon code for 8+2 base, 1 base error, 2 nocall correction
aaggttcaat

SEQ ID NO: 509 - DNA, 10 bp, Artificial Sequence
  synthetic Reed-Solomon code for 8+2 base, 1 base error, 2 nocall correction
gatgttcaca

SEQ ID NO: 510 - DNA, 10 bp, Artificial Sequence
  synthetic Reed-Solomon code for 8+2 base, 1 base error, 2 nocall correction
tctgttcata

SEQ ID NO: 511 - DNA, 10 bp, Artificial Sequence
  synthetic Reed-Solomon code for 8+2 base, 1 base error, 2 nocall correction
tttgttcagc

SEQ ID NO: 512 - DNA, 10 bp, Artificial Sequence
  synthetic Reed-Solomon code for 8+2 base, 1 base error, 2 nocall correction
tggtttcatc

SEQ ID NO: 513 - DNA, 10 bp, Artificial Sequence
  synthetic Reed-Solomon code for 8+2 base, 1 base error, 2 nocall correction
gaaaaagaca

SEQ ID NO: 514 - DNA, 10 bp, Artificial Sequence
  synthetic Reed-Solomon code for 8+2 base, 1 base error, 2 nocall correction
tcaaaagata

SEQ ID NO: 515 - DNA, 10 bp, Artificial Sequence
  synthetic Reed-Solomon code for 8+2 base, 1 base error, 2 nocall correction
ttaaaagagc

SEQ ID NO: 516 - DNA, 10 bp, Artificial Sequence
  synthetic Reed-Solomon code for 8+2 base, 1 base error, 2 nocall correction
tgcaaagagt

SEQ ID NO: 517 - DNA, 10 bp, Artificial Sequence
  synthetic Reed-Solomon code for 8+2 base, 1 base error, 2 nocall correction
aagaaagacg

SEQ ID NO: 518 - DNA, 10 bp, Artificial Sequence
  synthetic Reed-Solomon code for 8+2 base, 1 base error, 2 nocall correction
tagaaagaaa

SEQ ID NO: 519 - DNA, 10 bp, Artificial Sequence
  synthetic Reed-Solomon code for 8+2 base, 1 base error, 2 nocall correction
actaaagatt

SEQ ID NO: 520 - DNA, 10 bp, Artificial Sequence
  synthetic Reed-Solomon code for 8+2 base, 1 base error, 2 nocall correction
cgtaaagagc

SEQ ID NO: 521 - DNA, 10 bp, Artificial Sequence
  synthetic Reed-Solomon code for 8+2 base, 1 base error, 2 nocall correction
aaccaagatg

SEQ ID NO: 522 - DNA, 10 bp, Artificial Sequence
  synthetic Reed-Solomon code for 8+2 base, 1 base error, 2 nocall correction
gcccaagaaa

SEQ ID NO: 523 - DNA, 10 bp, Artificial Sequence
  synthetic Reed-Solomon code for 8+2 base, 1 base error, 2 nocall correction
tgagaagaga

SEQ ID NO: 524 - DNA, 10 bp, Artificial Sequence
  synthetic Reed-Solomon code for 8+2 base, 1 base error, 2 nocall correction
gacgaagact

SEQ ID NO: 525 - DNA, 10 bp, Artificial Sequence
  synthetic Reed-Solomon code for 8+2 base, 1 base error, 2 nocall correction
tccgaagatt

SEQ ID NO: 526 - DNA, 10 bp, Artificial Sequence
  synthetic Reed-Solomon code for 8+2 base, 1 base error, 2 nocall correction
cctgaagatc

SEQ ID NO: 527 - DNA, 10 bp, Artificial Sequence
  synthetic Reed-Solomon code for 8+2 base, 1 base error, 2 nocall correction
agtgaagagt

SEQ ID NO: 528 - DNA, 10 bp, Artificial Sequence
  synthetic Reed-Solomon code for 8+2 base, 1 base error, 2 nocall correction
cttgaagaga

SEQ ID NO: 529 - DNA, 10 bp, Artificial Sequence
  synthetic Reed-Solomon code for 8+2 base, 1 base error, 2 nocall correction
cggtaagata

SEQ ID NO: 530 - DNA, 10 bp, Artificial Sequence
  synthetic Reed-Solomon code for 8+2 base, 1 base error, 2 nocall correction
atgtaagatt

SEQ ID NO: 531 - DNA, 10 bp, Artificial Sequence
  synthetic Reed-Solomon code for 8+2 base, 1 base error, 2 nocall correction
gcaacagaac

SEQ ID NO: 532 - DNA, 10 bp, Artificial Sequence
  synthetic Reed-Solomon code for 8+2 base, 1 base error, 2 nocall correction
cacacagatg

SEQ ID NO: 533 - DNA, 10 bp, Artificial Sequence
  synthetic Reed-Solomon code for 8+2 base, 1 base error, 2 nocall correction
gagacagatc

SEQ ID NO: 534 - DNA, 10 bp, Artificial Sequence
  synthetic Reed-Solomon code for 8+2 base, 1 base error, 2 nocall correction
tcgacagacc

SEQ ID NO: 535 - DNA, 10 bp, Artificial Sequence
  synthetic Reed-Solomon code for 8+2 base, 1 base error, 2 nocall correction
gacccagacc

SEQ ID NO: 536 - DNA, 10 bp, Artificial Sequence
  synthetic Reed-Solomon code for 8+2 base, 1 base error, 2 nocall correction
tccccagatc

SEQ ID NO: 537 - DNA, 10 bp, Artificial Sequence
  synthetic Reed-Solomon code for 8+2 base, 1 base error, 2 nocall correction
ttcccagaga

SEQ ID NO: 538 - DNA, 10 bp, Artificial Sequence
  synthetic Reed-Solomon code for 8+2 base, 1 base error, 2 nocall correction
cagccagacg

SEQ ID NO: 539 - DNA, 10 bp, Artificial Sequence
  synthetic Reed-Solomon code for 8+2 base, 1 base error, 2 nocall correction
cctccagatt

SEQ ID NO: 540 - DNA, 10 bp, Artificial Sequence
  synthetic Reed-Solomon code for 8+2 base, 1 base error, 2 nocall correction
agtccagagc

SEQ ID NO: 541 - DNA, 10 bp, Artificial Sequence
  synthetic Reed-Solomon code for 8+2 base, 1 base error, 2 nocall correction
cgatcagacc

SEQ ID NO: 542 - DNA, 10 bp, Artificial Sequence
  synthetic Reed-Solomon code for 8+2 base, 1 base error, 2 nocall correction
agctcagaca

SEQ ID NO: 543 - DNA, 10 bp, Artificial Sequence
  synthetic Reed-Solomon code for 8+2 base, 1 base error, 2 nocall correction
tgctcagaag

SEQ ID NO: 544 - DNA, 10 bp, Artificial Sequence
  synthetic Reed-Solomon code for 8+2 base, 1 base error, 2 nocall correction
ctctcagact

SEQ ID NO: 545 - DNA, 10 bp, Artificial Sequence
  synthetic Reed-Solomon code for 8+2 base, 1 base error, 2 nocall correction
gattcagaga

SEQ ID NO: 546 - DNA, 10 bp, Artificial Sequence
  synthetic Reed-Solomon code for 8+2 base, 1 base error, 2 nocall correction
ttttcagacc

SEQ ID NO: 547 - DNA, 10 bp, Artificial Sequence
  synthetic Reed-Solomon code for 8+2 base, 1 base error, 2 nocall correction
aacagagact

SEQ ID NO: 548 - DNA, 10 bp, Artificial Sequence
  synthetic Reed-Solomon code for 8+2 base, 1 base error, 2 nocall correction
tggagagagg

SEQ ID NO: 549 - DNA, 10 bp, Artificial Sequence
  synthetic Reed-Solomon code for 8+2 base, 1 base error, 2 nocall correction
ggtagagagt

SEQ ID NO: 550 - DNA, 10 bp, Artificial Sequence
  synthetic Reed-Solomon code for 8+2 base, 1 base error, 2 nocall correction
acacgagaat

SEQ ID NO: 551 - DNA, 10 bp, Artificial Sequence
  synthetic Reed-Solomon code for 8+2 base, 1 base error, 2 nocall correction
aagcgagatt

SEQ ID NO: 552 - DNA, 10 bp, Artificial Sequence
  synthetic Reed-Solomon code for 8+2 base, 1 base error, 2 nocall correction
actcgagacg

SEQ ID NO: 553 - DNA, 10 bp, Artificial Sequence
  synthetic Reed-Solomon code for 8+2 base, 1 base error, 2 nocall correction
tctcgagaaa

SEQ ID NO: 554 - DNA, 10 bp, Artificial Sequence
  synthetic Reed-Solomon code for 8+2 base, 1 base error, 2 nocall correction
aaaggagaca

SEQ ID NO: 555 - DNA, 10 bp, Artificial Sequence
  synthetic Reed-Solomon code for 8+2 base, 1 base error, 2 nocall correction
taaggagaag

SEQ ID NO: 556 - DNA, 10 bp, Artificial Sequence
  synthetic Reed-Solomon code for 8+2 base, 1 base error, 2 nocall correction
cacggagacc

SEQ ID NO: 557 - DNA, 10 bp, Artificial Sequence
  synthetic Reed-Solomon code for 8+2 base, 1 base error, 2 nocall correction
gagggagacg

SEQ ID NO: 558 - DNA, 10 bp, Artificial Sequence
  synthetic Reed-Solomon code for 8+2 base, 1 base error, 2 nocall correction
tcgggagatg

SEQ ID NO: 559 - DNA, 10 bp, Artificial Sequence
  synthetic Reed-Solomon code for 8+2 base, 1 base error, 2 nocall correction
tatggagact

SEQ ID NO: 560 - DNA, 10 bp, Artificial Sequence
  synthetic Reed-Solomon code for 8+2 base, 1 base error, 2 nocall correction
gctggagatt

SEQ ID NO: 561 - DNA, 10 bp, Artificial Sequence
  synthetic Reed-Solomon code for 8+2 base, 1 base error, 2 nocall correction
ccatgagagg

SEQ ID NO: 562 - DNA, 10 bp, Artificial Sequence
  synthetic Reed-Solomon code for 8+2 base, 1 base error, 2 nocall correction
atctgagatg

SEQ ID NO: 563 - DNA, 10 bp, Artificial Sequence
  synthetic Reed-Solomon code for 8+2 base, 1 base error, 2 nocall correction
ttgatagatt

SEQ ID NO: 564 - DNA, 10 bp, Artificial Sequence
  synthetic Reed-Solomon code for 8+2 base, 1 base error, 2 nocall correction
gttatagatg

SEQ ID NO: 565 - DNA, 10 bp, Artificial Sequence
  synthetic Reed-Solomon code for 8+2 base, 1 base error, 2 nocall correction
tgactagacc

SEQ ID NO: 566 - DNA, 10 bp, Artificial Sequence
  synthetic Reed-Solomon code for 8+2 base, 1 base error, 2 nocall correction
cgcctagaag

SEQ ID NO: 567 - DNA, 10 bp, Artificial Sequence
  synthetic Reed-Solomon code for 8+2 base, 1 base error, 2 nocall correction
ttcctagact

SEQ ID NO: 568 - DNA, 10 bp, Artificial Sequence
  synthetic Reed-Solomon code for 8+2 base, 1 base error, 2 nocall correction
gggctagaac

SEQ ID NO: 569 - DNA, 10 bp, Artificial Sequence
  synthetic Reed-Solomon code for 8+2 base, 1 base error, 2 nocall correction
cttctagacc

SEQ ID NO: 570 - DNA, 10 bp, Artificial Sequence
  synthetic Reed-Solomon code for 8+2 base, 1 base error, 2 nocall correction
gaattagaag

SEQ ID NO: 571 - DNA, 10 bp, Artificial Sequence
  synthetic Reed-Solomon code for 8+2 base, 1 base error, 2 nocall correction
acattagata

SEQ ID NO: 572 - DNA, 10 bp, Artificial Sequence
  synthetic Reed-Solomon code for 8+2 base, 1 base error, 2 nocall correction
atattagagc

SEQ ID NO: 573 - DNA, 10 bp, Artificial Sequence
  synthetic Reed-Solomon code for 8+2 base, 1 base error, 2 nocall correction
cccttagatc

SEQ ID NO: 574 - DNA, 10 bp, Artificial Sequence
  synthetic Reed-Solomon code for 8+2 base, 1 base error, 2 nocall correction
agcttagagt

SEQ ID NO: 575 - DNA, 10 bp, Artificial Sequence
  synthetic Reed-Solomon code for 8+2 base, 1 base error, 2 nocall correction
ctcttagaga

SEQ ID NO: 576 - DNA, 10 bp, Artificial Sequence
  synthetic Reed-Solomon code for 8+2 base, 1 base error, 2 nocall correction
aagttagaaa

SEQ ID NO: 577 - DNA, 10 bp, Artificial Sequence
  synthetic Reed-Solomon code for 8+2 base, 1 base error, 2 nocall correction
tagttagacg

SEQ ID NO: 578 - DNA, 10 bp, Artificial Sequence
  synthetic Reed-Solomon code for 8+2 base, 1 base error, 2 nocall correction
gcgttagatg

SEQ ID NO: 579 - DNA, 10 bp, Artificial Sequence
  synthetic Reed-Solomon code for 8+2 base, 1 base error, 2 nocall correction
gatttagact

SEQ ID NO: 580 - DNA, 10 bp, Artificial Sequence
  synthetic Reed-Solomon code for 8+2 base, 1 base error, 2 nocall correction
tctttagatt

SEQ ID NO: 581 - DNA, 10 bp, Artificial Sequence
  synthetic Reed-Solomon code for 8+2 base, 1 base error, 2 nocall correction
gaaaacgaac

SEQ ID NO: 582 - DNA, 10 bp, Artificial Sequence
  synthetic Reed-Solomon code for 8+2 base, 1 base error, 2 nocall correction
ataaacgagg

SEQ ID NO: 583 - DNA, 10 bp, Artificial Sequence
  synthetic Reed-Solomon code for 8+2 base, 1 base error, 2 nocall correction
cccaacgatg

SEQ ID NO: 584 - DNA, 10 bp, Artificial Sequence
  synthetic Reed-Solomon code for 8+2 base, 1 base error, 2 nocall correction
tagaacgacc

SEQ ID NO: 585 - DNA, 10 bp, Artificial Sequence
  synthetic Reed-Solomon code for 8+2 base, 1 base error, 2 nocall correction
gcgaacgatc

SEQ ID NO: 586 - DNA, 10 bp, Artificial Sequence
  synthetic Reed-Solomon code for 8+2 base, 1 base error, 2 nocall correction
gtgaacgaga

SEQ ID NO: 587 - DNA, 10 bp, Artificial Sequence
  synthetic Reed-Solomon code for 8+2 base, 1 base error, 2 nocall correction
taccacgatc

SEQ ID NO: 588 - DNA, 10 bp, Artificial Sequence
  synthetic Reed-Solomon code for 8+2 base, 1 base error, 2 nocall correction
gcccacgacc

SEQ ID NO: 589 - DNA, 10 bp, Artificial Sequence
  synthetic Reed-Solomon code for 8+2 base, 1 base error, 2 nocall correction
ccgcacgacg

SEQ ID NO: 590 - DNA, 10 bp, Artificial Sequence
  synthetic Reed-Solomon code for 8+2 base, 1 base error, 2 nocall correction
catcacgatt

SEQ ID NO: 591 - DNA, 10 bp, Artificial Sequence
  synthetic Reed-Solomon code for 8+2 base, 1 base error, 2 nocall correction
cgcgacgagg

SEQ ID NO: 592 - DNA, 10 bp, Artificial Sequence
  synthetic Reed-Solomon code for 8+2 base, 1 base error, 2 nocall correction
ggggacgagc

SEQ ID NO: 593 - DNA, 10 bp, Artificial Sequence
  synthetic Reed-Solomon code for 8+2 base, 1 base error, 2 nocall correction
gcttacgaga

SEQ ID NO: 594 - DNA, 10 bp, Artificial Sequence
  synthetic Reed-Solomon code for 8+2 base, 1 base error, 2 nocall correction
gtttacgatc

SEQ ID NO: 595 - DNA, 10 bp, Artificial Sequence
  synthetic Reed-Solomon code for 8+2 base, 1 base error, 2 nocall correction
taaaccgata

SEQ ID NO: 596 - DNA, 10 bp, Artificial Sequence
  synthetic Reed-Solomon code for 8+2 base, 1 base error, 2 nocall correction
gcaaccgaca

SEQ ID NO: 597 - DNA, 10 bp, Artificial Sequence
  synthetic Reed-Solomon code for 8+2 base, 1 base error, 2 nocall correction
acgaccgacg

SEQ ID NO: 598 - DNA, 10 bp, Artificial Sequence
  synthetic Reed-Solomon code for 8+2 base, 1 base error, 2 nocall correction
tcgaccgaaa

SEQ ID NO: 599 - DNA, 10 bp, Artificial Sequence
  synthetic Reed-Solomon code for 8+2 base, 1 base error, 2 nocall correction
aataccgatt

SEQ ID NO: 600 - DNA, 10 bp, Artificial Sequence
  synthetic Reed-Solomon code for 8+2 base, 1 base error, 2 nocall correction
ctacccgagg

SEQ ID NO: 601 - DNA, 10 bp, Artificial Sequence
  synthetic Reed-Solomon code for 8+2 base, 1 base error, 2 nocall correction
gaccccgaaa

SEQ ID NO: 602 - DNA, 10 bp, Artificial Sequence
  synthetic Reed-Solomon code for 8+2 base, 1 base error, 2 nocall correction
acccccgatg

SEQ ID NO: 603 - DNA, 10 bp, Artificial Sequence
  synthetic Reed-Solomon code for 8+2 base, 1 base error, 2 nocall correction
gggcccgagt

SEQ ID NO: 604 - DNA, 10 bp, Artificial Sequence
  synthetic Reed-Solomon code for 8+2 base, 1 base error, 2 nocall correction
tgtcccgagg

SEQ ID NO: 605 - DNA, 10 bp, Artificial Sequence
  synthetic Reed-Solomon code for 8+2 base, 1 base error, 2 nocall correction
tacgccgatt

SEQ ID NO: 606 - DNA, 10 bp, Artificial Sequence
  synthetic Reed-Solomon code for 8+2 base, 1 base error, 2 nocall correction
gccgccgact

SEQ ID NO: 607 - DNA, 10 bp, Artificial Sequence
  synthetic Reed-Solomon code for 8+2 base, 1 base error, 2 nocall correction
catgccgatc

SEQ ID NO: 608 - DNA, 10 bp, Artificial Sequence
  synthetic Reed-Solomon code for 8+2 base, 1 base error, 2 nocall correction
cgatccgaaa

SEQ ID NO: 609 - DNA, 10 bp, Artificial Sequence
  synthetic Reed-Solomon code for 8+2 base, 1 base error, 2 nocall correction
atatccgaat

SEQ ID NO: 610 - DNA, 10 bp, Artificial Sequence
  synthetic Reed-Solomon code for 8+2 base, 1 base error, 2 nocall correction
agctccgaac

SEQ ID NO: 611 - DNA, 10 bp, Artificial Sequence
  synthetic Reed-Solomon code for 8+2 base, 1 base error, 2 nocall correction
atttccgacg

SEQ ID NO: 612 - DNA, 10 bp, Artificial Sequence
  synthetic Reed-Solomon code for 8+2 base, 1 base error, 2 nocall correction
ttttccgaaa

SEQ ID NO: 613 - DNA, 10 bp, Artificial Sequence
  synthetic Reed-Solomon code for 8+2 base, 1 base error, 2 nocall correction
caaagcgaat

SEQ ID NO: 614 - DNA, 10 bp, Artificial Sequence
  synthetic Reed-Solomon code for 8+2 base, 1 base error, 2 nocall correction
ccgagcgatt

SEQ ID NO: 615 - DNA, 10 bp, Artificial Sequence
  synthetic Reed-Solomon code for 8+2 base, 1 base error, 2 nocall correction
aggagcgagc

SEQ ID NO: 616 - DNA, 10 bp, Artificial Sequence
  synthetic Reed-Solomon code for 8+2 base, 1 base error, 2 nocall correction
catagcgacg

SEQ ID NO: 617 - DNA, 10 bp, Artificial Sequence
  synthetic Reed-Solomon code for 8+2 base, 1 base error, 2 nocall correction
ccccgcgact

SEQ ID NO: 618 - DNA, 10 bp, Artificial Sequence
  synthetic Reed-Solomon code for 8+2 base, 1 base error, 2 nocall correction
gatcgcgatc

SEQ ID NO: 619 - DNA, 10 bp, Artificial Sequence
  synthetic Reed-Solomon code for 8+2 base, 1 base error, 2 nocall correction
tctcgcgacc

SEQ ID NO: 620 - DNA, 10 bp, Artificial Sequence
  synthetic Reed-Solomon code for 8+2 base, 1 base error, 2 nocall correction
aaaggcgaac

SEQ ID NO: 621 - DNA, 10 bp, Artificial Sequence
  synthetic Reed-Solomon code for 8+2 base, 1 base error, 2 nocall correction
gtaggcgagg

SEQ ID NO: 622 - DNA, 10 bp, Artificial Sequence
  synthetic Reed-Solomon code for 8+2 base, 1 base error, 2 nocall correction
cacggcgaaa

SEQ ID NO: 623 - DNA, 10 bp, Artificial Sequence
  synthetic Reed-Solomon code for 8+2 base, 1 base error, 2 nocall correction
acgggcgatc

SEQ ID NO: 624 - DNA, 10 bp, Artificial Sequence
  synthetic Reed-Solomon code for 8+2 base, 1 base error, 2 nocall correction
cggggcgagt

SEQ ID NO: 625 - DNA, 10 bp, Artificial Sequence
  synthetic Reed-Solomon code for 8+2 base, 1 base error, 2 nocall correction
atgggcgaga

SEQ ID NO: 626 - DNA, 10 bp, Artificial Sequence
  synthetic Reed-Solomon code for 8+2 base, 1 base error, 2 nocall correction
tgatgcgatt

SEQ ID NO: 627 - DNA, 10 bp, Artificial Sequence
  synthetic Reed-Solomon code for 8+2 base, 1 base error, 2 nocall correction
tcctgcgaga

SEQ ID NO: 628 - DNA, 10 bp, Artificial Sequence
  synthetic Reed-Solomon code for 8+2 base, 1 base error, 2 nocall correction
ttctgcgatc

SEQ ID NO: 629 - DNA, 10 bp, Artificial Sequence
  synthetic Reed-Solomon code for 8+2 base, 1 base error, 2 nocall correction
agttgcgata

SEQ ID NO: 630 - DNA, 10 bp, Artificial Sequence
  synthetic Reed-Solomon code for 8+2 base, 1 base error, 2 nocall correction
ctttgcgatt

SEQ ID NO: 631 - DNA, 10 bp, Artificial Sequence
  synthetic Reed-Solomon code for 8+2 base, 1 base error, 2 nocall correction
gcaatcgagt

SEQ ID NO: 632 - DNA, 10 bp, Artificial Sequence
  synthetic Reed-Solomon code for 8+2 base, 1 base error, 2 nocall correction
ggcatcgata

SEQ ID NO: 633 - DNA, 10 bp, Artificial Sequence
  synthetic Reed-Solomon code for 8+2 base, 1 base error, 2 nocall correction
agactcgacg

SEQ ID NO: 634 - DNA, 10 bp, Artificial Sequence
  synthetic Reed-Solomon code for 8+2 base, 1 base error, 2 nocall correction
tgactcgaaa

SEQ ID NO: 635 - DNA, 10 bp, Artificial Sequence
  synthetic Reed-Solomon code for 8+2 base, 1 base error, 2 nocall correction
gggctcgaca

SEQ ID NO: 636 - DNA, 10 bp, Artificial Sequence
  synthetic Reed-Solomon code for 8+2 base, 1 base error, 2 nocall correction
agtctcgaat

SEQ ID NO: 637 - DNA, 10 bp, Artificial Sequence
  synthetic Reed-Solomon code for 8+2 base, 1 base error, 2 nocall correction
cttctcgaaa

SEQ ID NO: 638 - DNA, 10 bp, Artificial Sequence
  synthetic Reed-Solomon code for 8+2 base, 1 base error, 2 nocall correction
ggagtcgatt

SEQ ID NO: 639 - DNA, 10 bp, Artificial Sequence
  synthetic Reed-Solomon code for 8+2 base, 1 base error, 2 nocall correction
gccgtcgaga

SEQ ID NO: 640 - DNA, 10 bp, Artificial Sequence
  synthetic Reed-Solomon code for 8+2 base, 1 base error, 2 nocall correction
gtcgtcgatc

SEQ ID NO: 641 - DNA, 10 bp, Artificial Sequence
  synthetic Reed-Solomon code for 8+2 base, 1 base error, 2 nocall correction
ctggtcgatg

SEQ ID NO: 642 - DNA, 10 bp, Artificial Sequence
  synthetic Reed-Solomon code for 8+2 base, 1 base error, 2 nocall correction
ttattcgagg

SEQ ID NO: 643 - DNA, 10 bp, Artificial Sequence
  synthetic Reed-Solomon code for 8+2 base, 1 base error, 2 nocall correction
aagttcgacc

SEQ ID NO: 644 - DNA, 10 bp, Artificial Sequence
  synthetic Reed-Solomon code for 8+2 base, 1 base error, 2 nocall correction
cgtttcgagg

SEQ ID NO: 645 - DNA, 10 bp, Artificial Sequence
  synthetic Reed-Solomon code for 8+2 base, 1 base error, 2 nocall correction
ataaaggacc

SEQ ID NO: 646 - DNA, 10 bp, Artificial Sequence
  synthetic Reed-Solomon code for 8+2 base, 1 base error, 2 nocall correction
agcaaggact

SEQ ID NO: 647 - DNA, 10 bp, Artificial Sequence
  synthetic Reed-Solomon code for 8+2 base, 1 base error, 2 nocall correction
ctcaaggaca

SEQ ID NO: 648 - DNA, 10 bp, Artificial Sequence
  synthetic Reed-Solomon code for 8+2 base, 1 base error, 2 nocall correction
tagaaggagg

SEQ ID NO: 649 - DNA, 10 bp, Artificial Sequence
  synthetic Reed-Solomon code for 8+2 base, 1 base error, 2 nocall correction
gataaggagt

SEQ ID NO: 650 - DNA, 10 bp, Artificial Sequence
  synthetic Reed-Solomon code for 8+2 base, 1 base error, 2 nocall correction
gcccaggagg

SEQ ID NO: 651 - DNA, 10 bp, Artificial Sequence
  synthetic Reed-Solomon code for 8+2 base, 1 base error, 2 nocall correction
ccgcaggagc

SEQ ID NO: 652 - DNA, 10 bp, Artificial Sequence
  synthetic Reed-Solomon code for 8+2 base, 1 base error, 2 nocall correction
aggcaggatt

SEQ ID NO: 653 - DNA, 10 bp, Artificial Sequence
  synthetic Reed-Solomon code for 8+2 base, 1 base error, 2 nocall correction
ctgcaggata

SEQ ID NO: 654 - DNA, 10 bp, Artificial Sequence
  synthetic Reed-Solomon code for 8+2 base, 1 base error, 2 nocall correction
agagaggaca

SEQ ID NO: 655 - DNA, 10 bp, Artificial Sequence
  synthetic Reed-Solomon code for 8+2 base, 1 base error, 2 nocall correction
tgagaggaag

SEQ ID NO: 656 - DNA, 10 bp, Artificial Sequence
  synthetic Reed-Solomon code for 8+2 base, 1 base error, 2 nocall correction
ctagaggact

SEQ ID NO: 657 - DNA, 10 bp, Artificial Sequence
  synthetic Reed-Solomon code for 8+2 base, 1 base error, 2 nocall correction
cgcgaggacc

SEQ ID NO: 658 - DNA, 10 bp, Artificial Sequence
  synthetic Reed-Solomon code for 8+2 base, 1 base error, 2 nocall correction
ggggaggacg

SEQ ID NO: 659 - DNA, 10 bp, Artificial Sequence
  synthetic Reed-Solomon code for 8+2 base, 1 base error, 2 nocall correction
tgtgaggact

SEQ ID NO: 660 - DNA, 10 bp, Artificial Sequence
  synthetic Reed-Solomon code for 8+2 base, 1 base error, 2 nocall correction
cttgaggaag

SEQ ID NO: 661 - DNA, 10 bp, Artificial Sequence
  synthetic Reed-Solomon code for 8+2 base, 1 base error, 2 nocall correction
gtaacggatg

SEQ ID NO: 662 - DNA, 10 bp, Artificial Sequence
  synthetic Reed-Solomon code for 8+2 base, 1 base error, 2 nocall correction
acgacggagc

SEQ ID NO: 663 - DNA, 10 bp, Artificial Sequence
  synthetic Reed-Solomon code for 8+2 base, 1 base error, 2 nocall correction
cggacggatt

SEQ ID NO: 664 - DNA, 10 bp, Artificial Sequence
  synthetic Reed-Solomon code for 8+2 base, 1 base error, 2 nocall correction
atgacggata

SEQ ID NO: 665 - DNA, 10 bp, Artificial Sequence
  synthetic Reed-Solomon code for 8+2 base, 1 base error, 2 nocall correction
ctaccggacc

SEQ ID NO: 666 - DNA, 10 bp, Artificial Sequence
  synthetic Reed-Solomon code for 8+2 base, 1 base error, 2 nocall correction
cgcccggact

SEQ ID NO: 667 - DNA, 10 bp, Artificial Sequence
  synthetic Reed-Solomon code for 8+2 base, 1 base error, 2 nocall correction
atcccggaca

SEQ ID NO: 668 - DNA, 10 bp, Artificial Sequence
  synthetic Reed-Solomon code for 8+2 base, 1 base error, 2 nocall correction
ttcccggaag

SEQ ID NO: 669 - DNA, 10 bp, Artificial Sequence
  synthetic Reed-Solomon code for 8+2 base, 1 base error, 2 nocall correction
tgtccggacc

SEQ ID NO: 670 - DNA, 10 bp, Artificial Sequence
  synthetic Reed-Solomon code for 8+2 base, 1 base error, 2 nocall correction
ccggcggagt

SEQ ID NO: 671 - DNA, 10 bp, Artificial Sequence
  synthetic Reed-Solomon code for 8+2 base, 1 base error, 2 nocall correction
agggcggatc

SEQ ID NO: 672 - DNA, 10 bp, Artificial Sequence
  synthetic Reed-Solomon code for 8+2 base, 1 base error, 2 nocall correction
gaatcggact

SEQ ID NO: 673 - DNA, 10 bp, Artificial Sequence
  synthetic Reed-Solomon code for 8+2 base, 1 base error, 2 nocall correction
tcatcggatt

SEQ ID NO: 674 - DNA, 10 bp, Artificial Sequence
  synthetic Reed-Solomon code for 8+2 base, 1 base error, 2 nocall correction
tgctcggaga

SEQ ID NO: 675 - DNA, 10 bp, Artificial Sequence
  synthetic Reed-Solomon code for 8+2 base, 1 base error, 2 nocall correction
tagtcggaat

SEQ ID NO: 676 - DNA, 10 bp, Artificial Sequence
  synthetic Reed-Solomon code for 8+2 base, 1 base error, 2 nocall correction
gattcggaag

SEQ ID NO: 677 - DNA, 10 bp, Artificial Sequence
  synthetic Reed-Solomon code for 8+2 base, 1 base error, 2 nocall correction
acttcggata

SEQ ID NO: 678 - DNA, 10 bp, Artificial Sequence
  synthetic Reed-Solomon code for 8+2 base, 1 base error, 2 nocall correction
atttcggagc

SEQ ID NO: 679 - DNA, 10 bp, Artificial Sequence
  synthetic Reed-Solomon code for 8+2 base, 1 base error, 2 nocall correction
ggaagggaca

SEQ ID NO: 680 - DNA, 10 bp, Artificial Sequence
  synthetic Reed-Solomon code for 8+2 base, 1 base error, 2 nocall correction
tacagggagt

SEQ ID NO: 681 - DNA, 10 bp, Artificial Sequence
  synthetic Reed-Solomon code for 8+2 base, 1 base error, 2 nocall correction
aggagggacg

SEQ ID NO: 682 - DNA, 10 bp, Artificial Sequence
  synthetic Reed-Solomon code for 8+2 base, 1 base error, 2 nocall correction
tggagggaaa

SEQ ID NO: 683 - DNA, 10 bp, Artificial Sequence
  synthetic Reed-Solomon code for 8+2 base, 1 base error, 2 nocall correction
catagggagc

SEQ ID NO: 684 - DNA, 10 bp, Artificial Sequence
  synthetic Reed-Solomon code for 8+2 base, 1 base error, 2 nocall correction
agccgggatg

SEQ ID NO: 685 - DNA, 10 bp, Artificial Sequence
  synthetic Reed-Solomon code for 8+2 base, 1 base error, 2 nocall correction
gcgcgggagt

SEQ ID NO: 686 - DNA, 10 bp, Artificial Sequence
  synthetic Reed-Solomon code for 8+2 base, 1 base error, 2 nocall correction
tctcgggagg

SEQ ID NO: 687 - DNA, 10 bp, Artificial Sequence
  synthetic Reed-Solomon code for 8+2 base, 1 base error, 2 nocall correction
taaggggaga

SEQ ID NO: 688 - DNA, 10 bp, Artificial Sequence
  synthetic Reed-Solomon code for 8+2 base, 1 base error, 2 nocall correction
gtaggggacc

SEQ ID NO: 689 - DNA, 10 bp, Artificial Sequence
  synthetic Reed-Solomon code for 8+2 base, 1 base error, 2 nocall correction
ggcggggact

SEQ ID NO: 690 - DNA, 10 bp, Artificial Sequence
  synthetic Reed-Solomon code for 8+2 base, 1 base error, 2 nocall correction
ttgggggaac

SEQ ID NO: 691 - DNA, 10 bp, Artificial Sequence
  synthetic Reed-Solomon code for 8+2 base, 1 base error, 2 nocall correction
aatggggagt

SEQ ID NO: 692 - DNA, 10 bp, Artificial Sequence
  synthetic Reed-Solomon code for 8+2 base, 1 base error, 2 nocall correction
ccatgggaaa

SEQ ID NO: 693 - DNA, 10 bp, Artificial Sequence
  synthetic Reed-Solomon code for 8+2 base, 1 base error, 2 nocall correction
acctgggaac

SEQ ID NO: 694 - DNA, 10 bp, Artificial Sequence
  synthetic Reed-Solomon code for 8+2 base, 1 base error, 2 nocall correction
cagtgggata

SEQ ID NO: 695 - DNA, 10 bp, Artificial Sequence
  synthetic Reed-Solomon code for 8+2 base, 1 base error, 2 nocall correction
gctatggaac

SEQ ID NO: 696 - DNA, 10 bp, Artificial Sequence
  synthetic Reed-Solomon code for 8+2 base, 1 base error, 2 nocall correction
ccactggatt

SEQ ID NO: 697 - DNA, 10 bp, Artificial Sequence
  synthetic Reed-Solomon code for 8+2 base, 1 base error, 2 nocall correction
agactggagc

SEQ ID NO: 698 - DNA, 10 bp, Artificial Sequence
  synthetic Reed-Solomon code for 8+2 base, 1 base error, 2 nocall correction
cgcctggaga

SEQ ID NO: 699 - DNA, 10 bp, Artificial Sequence
  synthetic Reed-Solomon code for 8+2 base, 1 base error, 2 nocall correction
atcctggagt

SEQ ID NO: 700 - DNA, 10 bp, Artificial Sequence
  synthetic Reed-Solomon code for 8+2 base, 1 base error, 2 nocall correction
cagctggaat

SEQ ID NO: 701 - DNA, 10 bp, Artificial Sequence
  synthetic Reed-Solomon code for 8+2 base, 1 base error, 2 nocall correction
ccggtggaca

SEQ ID NO: 702 - DNA, 10 bp, Artificial Sequence
  synthetic Reed-Solomon code for 8+2 base, 1 base error, 2 nocall correction
gaattggaga

SEQ ID NO: 703 - DNA, 10 bp, Artificial Sequence
  synthetic Reed-Solomon code for 8+2 base, 1 base error, 2 nocall correction
ttattggacc

SEQ ID NO: 704 - DNA, 10 bp, Artificial Sequence
  synthetic Reed-Solomon code for 8+2 base, 1 base error, 2 nocall correction
tgcttggact

SEQ ID NO: 705 - DNA, 10 bp, Artificial Sequence
  synthetic Reed-Solomon code for 8+2 base, 1 base error, 2 nocall correction
ctcttggaag

SEQ ID NO: 706 - DNA, 10 bp, Artificial Sequence
  synthetic Reed-Solomon code for 8+2 base, 1 base error, 2 nocall correction
aagttggagg

SEQ ID NO: 707 - DNA, 10 bp, Artificial Sequence
  synthetic Reed-Solomon code for 8+2 base, 1 base error, 2 nocall correction
gtgttggaac

SEQ ID NO: 708 - DNA, 10 bp, Artificial Sequence
  synthetic Reed-Solomon code for 8+2 base, 1 base error, 2 nocall correction
cgtttggacc

SEQ ID NO: 709 - DNA, 10 bp, Artificial Sequence
  synthetic Reed-Solomon code for 8+2 base, 1 base error, 2 nocall correction
tcaaatgaat

SEQ ID NO: 710 - DNA, 10 bp, Artificial Sequence
  synthetic Reed-Solomon code for 8+2 base, 1 base error, 2 nocall correction
tagaatgatt

SEQ ID NO: 711 - DNA, 10 bp, Artificial Sequence
  synthetic Reed-Solomon code for 8+2 base, 1 base error, 2 nocall correction
gcgaatgact

SEQ ID NO: 712 - DNA, 10 bp, Artificial Sequence
  synthetic Reed-Solomon code for 8+2 base, 1 base error, 2 nocall correction
gataatgatg

SEQ ID NO: 713 - DNA, 10 bp, Artificial Sequence
  synthetic Reed-Solomon code for 8+2 base, 1 base error, 2 nocall correction
actaatgaaa

SEQ ID NO: 714 - DNA, 10 bp, Artificial Sequence
  synthetic Reed-Solomon code for 8+2 base, 1 base error, 2 nocall correction
tctaatgacg

SEQ ID NO: 715 - DNA, 10 bp, Artificial Sequence
  synthetic Reed-Solomon code for 8+2 base, 1 base error, 2 nocall correction
ggacatgaga

SEQ ID NO: 716 - DNA, 10 bp, Artificial Sequence
  synthetic Reed-Solomon code for 8+2 base, 1 base error, 2 nocall correction
taccatgact

SEQ ID NO: 717 - DNA, 10 bp, Artificial Sequence
  synthetic Reed-Solomon code for 8+2 base, 1 base error, 2 nocall correction
gcccatgatt

SEQ ID NO: 718 - DNA, 10 bp, Artificial Sequence
  synthetic Reed-Solomon code for 8+2 base, 1 base error, 2 nocall correction
aggcatgagg

SEQ ID NO: 719 - DNA, 10 bp, Artificial Sequence
  synthetic Reed-Solomon code for 8+2 base, 1 base error, 2 nocall correction
catcatgacc

SEQ ID NO: 720 - DNA, 10 bp, Artificial Sequence
  synthetic Reed-Solomon code for 8+2 base, 1 base error, 2 nocall correction
accgatgacg

SEQ ID NO: 721 - DNA, 10 bp, Artificial Sequence
  synthetic Reed-Solomon code for 8+2 base, 1 base error, 2 nocall correction
tccgatgaaa

SEQ ID NO: 722 - DNA, 10 bp, Artificial Sequence
  synthetic Reed-Solomon code for 8+2 base, 1 base error, 2 nocall correction
aaatatgagc

SEQ ID NO: 723 - DNA, 10 bp, Artificial Sequence
  synthetic Reed-Solomon code for 8+2 base, 1 base error, 2 nocall correction
gtatatgaag

SEQ ID NO: 724 - DNA, 10 bp, Artificial Sequence
  synthetic Reed-Solomon code for 8+2 base, 1 base error, 2 nocall correction
cactatgaga

SEQ ID NO: 725 - DNA, 10 bp, Artificial Sequence
  synthetic Reed-Solomon code for 8+2 base, 1 base error, 2 nocall correction
cggtatgaat

SEQ ID NO: 726 - DNA, 10 bp, Artificial Sequence
  synthetic Reed-Solomon code for 8+2 base, 1 base error, 2 nocall correction
atgtatgaaa

SEQ ID NO: 727 - DNA, 10 bp, Artificial Sequence
  synthetic Reed-Solomon code for 8+2 base, 1 base error, 2 nocall correction
ttgtatgacg

SEQ ID NO: 728 - DNA, 10 bp, Artificial Sequence
  synthetic Reed-Solomon code for 8+2 base, 1 base error, 2 nocall correction
gtttatgact

SEQ ID NO: 729 - DNA, 10 bp, Artificial Sequence
  synthetic Reed-Solomon code for 8+2 base, 1 base error, 2 nocall correction
gtaactgagt

SEQ ID NO: 730 - DNA, 10 bp, Artificial Sequence
  synthetic Reed-Solomon code for 8+2 base, 1 base error, 2 nocall correction
ggcactgagc

SEQ ID NO: 731 - DNA, 10 bp, Artificial Sequence
  synthetic Reed-Solomon code for 8+2 base, 1 base error, 2 nocall correction
cggactgagg

SEQ ID NO: 732 - DNA, 10 bp, Artificial Sequence
  synthetic Reed-Solomon code for 8+2 base, 1 base error, 2 nocall correction
aatactgacc

SEQ ID NO: 733 - DNA, 10 bp, Artificial Sequence
  synthetic Reed-Solomon code for 8+2 base, 1 base error, 2 nocall correction
cctcctgaaa

SEQ ID NO: 734 - DNA, 10 bp, Artificial Sequence
  synthetic Reed-Solomon code for 8+2 base, 1 base error, 2 nocall correction
caagctgaag

SEQ ID NO: 735 - DNA, 10 bp, Artificial Sequence
  synthetic Reed-Solomon code for 8+2 base, 1 base error, 2 nocall correction
tacgctgacc

SEQ ID NO: 736 - DNA, 10 bp, Artificial Sequence
  synthetic Reed-Solomon code for 8+2 base, 1 base error, 2 nocall correction
gccgctgatc

SEQ ID NO: 737 - DNA, 10 bp, Artificial Sequence
  synthetic Reed-Solomon code for 8+2 base, 1 base error, 2 nocall correction
gtcgctgaga

SEQ ID NO: 738 - DNA, 10 bp, Artificial Sequence
  synthetic Reed-Solomon code for 8+2 base, 1 base error, 2 nocall correction
ccggctgatg

SEQ ID NO: 739 - DNA, 10 bp, Artificial Sequence
  synthetic Reed-Solomon code for 8+2 base, 1 base error, 2 nocall correction
catgctgact

SEQ ID NO: 740 - DNA, 10 bp, Artificial Sequence
  synthetic Reed-Solomon code for 8+2 base, 1 base error, 2 nocall correction
tcatctgagg

SEQ ID NO: 741 - DNA, 10 bp, Artificial Sequence
  synthetic Reed-Solomon code for 8+2 base, 1 base error, 2 nocall correction
tacagtgatg

SEQ ID NO: 742 - DNA, 10 bp, Artificial Sequence
  synthetic Reed-Solomon code for 8+2 base, 1 base error, 2 nocall correction
gccagtgacg

SEQ ID NO: 743 - DNA, 10 bp, Artificial Sequence
  synthetic Reed-Solomon code for 8+2 base, 1 base error, 2 nocall correction
ccgagtgacc

SEQ ID NO: 744 - DNA, 10 bp, Artificial Sequence
  synthetic Reed-Solomon code for 8+2 base, 1 base error, 2 nocall correction
gaacgtgaag

SEQ ID NO: 745 - DNA, 10 bp, Artificial Sequence
  synthetic Reed-Solomon code for 8+2 base, 1 base error, 2 nocall correction
acacgtgata

SEQ ID NO: 746 - DNA, 10 bp, Artificial Sequence
  synthetic Reed-Solomon code for 8+2 base, 1 base error, 2 nocall correction
atacgtgagc

SEQ ID NO: 747 - DNA, 10 bp, Artificial Sequence
  synthetic Reed-Solomon code for 8+2 base, 1 base error, 2 nocall correction
ccccgtgatc

SEQ ID NO: 748 - DNA, 10 bp, Artificial Sequence
  synthetic Reed-Solomon code for 8+2 base, 1 base error, 2 nocall correction
agccgtgagt

SEQ ID NO: 749 - DNA, 10 bp, Artificial Sequence
  synthetic Reed-Solomon code for 8+2 base, 1 base error, 2 nocall correction
ctccgtgaga

SEQ ID NO: 750 - DNA, 10 bp, Artificial Sequence
  synthetic Reed-Solomon code for 8+2 base, 1 base error, 2 nocall correction
aagcgtgaaa

SEQ ID NO: 751 - DNA, 10 bp, Artificial Sequence
  synthetic Reed-Solomon code for 8+2 base, 1 base error, 2 nocall correction
tagcgtgacg

SEQ ID NO: 752 - DNA, 10 bp, Artificial Sequence
  synthetic Reed-Solomon code for 8+2 base, 1 base error, 2 nocall correction
gcgcgtgatg

SEQ ID NO: 753 - DNA, 10 bp, Artificial Sequence
  synthetic Reed-Solomon code for 8+2 base, 1 base error, 2 nocall correction
gatcgtgact

SEQ ID NO: 754 - DNA, 10 bp, Artificial Sequence
  synthetic Reed-Solomon code for 8+2 base, 1 base error, 2 nocall correction
tctcgtgatt

SEQ ID NO: 755 - DNA, 10 bp, Artificial Sequence
  synthetic Reed-Solomon code for 8+2 base, 1 base error, 2 nocall correction
acgggtgact

SEQ ID NO: 756 - DNA, 10 bp, Artificial Sequence
  synthetic Reed-Solomon code for 8+2 base, 1 base error, 2 nocall correction
aatggtgatg

SEQ ID NO: 757 - DNA, 10 bp, Artificial Sequence
  synthetic Reed-Solomon code for 8+2 base, 1 base error, 2 nocall correction
gctggtgaaa

SEQ ID NO: 758 - DNA, 10 bp, Artificial Sequence
  synthetic Reed-Solomon code for 8+2 base, 1 base error, 2 nocall correction
tgatgtgacc

SEQ ID NO: 759 - DNA, 10 bp, Artificial Sequence
  synthetic Reed-Solomon code for 8+2 base, 1 base error, 2 nocall correction
cgctgtgaag

SEQ ID NO: 760 - DNA, 10 bp, Artificial Sequence
  synthetic Reed-Solomon code for 8+2 base, 1 base error, 2 nocall correction
ttctgtgact

SEQ ID NO: 761 - DNA, 10 bp, Artificial Sequence
  synthetic Reed-Solomon code for 8+2 base, 1 base error, 2 nocall correction
gggtgtgaac

SEQ ID NO: 762 - DNA, 10 bp, Artificial Sequence
  synthetic Reed-Solomon code for 8+2 base, 1 base error, 2 nocall correction
ctttgtgacc

SEQ ID NO: 763 - DNA, 10 bp, Artificial Sequence
  synthetic Reed-Solomon code for 8+2 base, 1 base error, 2 nocall correction
taaattgagc

SEQ ID NO: 764 - DNA, 10 bp, Artificial Sequence
  synthetic Reed-Solomon code for 8+2 base, 1 base error, 2 nocall correction
gtaattgaca

SEQ ID NO: 765 - DNA, 10 bp, Artificial Sequence
  synthetic Reed-Solomon code for 8+2 base, 1 base error, 2 nocall correction
atgattgacg

SEQ ID NO: 766 - DNA, 10 bp, Artificial Sequence
  synthetic Reed-Solomon code for 8+2 base, 1 base error, 2 nocall correction
ttgattgaaa

SEQ ID NO: 767 - DNA, 10 bp, Artificial Sequence
  synthetic Reed-Solomon code for 8+2 base, 1 base error, 2 nocall correction
ccacttgagg

SEQ ID NO: 768 - DNA, 10 bp, Artificial Sequence
  synthetic Reed-Solomon code for 8+2 base, 1 base error, 2 nocall correction
atccttgatg

SEQ ID NO: 769 - DNA, 10 bp, Artificial Sequence
  synthetic Reed-Solomon code for 8+2 base, 1 base error, 2 nocall correction
ggagttgacc

SEQ ID NO: 770 - DNA, 10 bp, Artificial Sequence
  synthetic Reed-Solomon code for 8+2 base, 1 base error, 2 nocall correction
gtcgttgact

SEQ ID NO: 771 - DNA, 10 bp, Artificial Sequence
  synthetic Reed-Solomon code for 8+2 base, 1 base error, 2 nocall correction
tgggttgaac

SEQ ID NO: 772 - DNA, 10 bp, Artificial Sequence
  synthetic Reed-Solomon code for 8+2 base, 1 base error, 2 nocall correction
catgttgaga

SEQ ID NO: 773 - DNA, 10 bp, Artificial Sequence
  synthetic Reed-Solomon code for 8+2 base, 1 base error, 2 nocall correction
acatttgaat

SEQ ID NO: 774 - DNA, 10 bp, Artificial Sequence
  synthetic Reed-Solomon code for 8+2 base, 1 base error, 2 nocall correction
aagtttgatt

SEQ ID NO: 775 - DNA, 10 bp, Artificial Sequence
  synthetic Reed-Solomon code for 8+2 base, 1 base error, 2 nocall correction
acttttgacg

SEQ ID NO: 776 - DNA, 10 bp, Artificial Sequence
  synthetic Reed-Solomon code for 8+2 base, 1 base error, 2 nocall correction
tcttttgaaa

SEQ ID NO: 777 - DNA, 10 bp, Artificial Sequence
  synthetic Reed-Solomon code for 8+2 base, 1 base error, 2 nocall correction
gcaaaataga

SEQ ID NO: 778 - DNA, 10 bp, Artificial Sequence
  synthetic Reed-Solomon code for 8+2 base, 1 base error, 2 nocall correction
gtaaaatatc

SEQ ID NO: 779 - DNA, 10 bp, Artificial Sequence
  synthetic Reed-Solomon code for 8+2 base, 1 base error, 2 nocall correction
ggcaaatatt

SEQ ID NO: 780 - DNA, 10 bp, Artificial Sequence
  synthetic Reed-Solomon code for 8+2 base, 1 base error, 2 nocall correction
acgaaatagg

SEQ ID NO: 781 - DNA, 10 bp, Artificial Sequence
  synthetic Reed-Solomon code for 8+2 base, 1 base error, 2 nocall correction
tgacaataat

SEQ ID NO: 782 - DNA, 10 bp, Artificial Sequence
  synthetic Reed-Solomon code for 8+2 base, 1 base error, 2 nocall correction
ctacaatacg

SEQ ID NO: 783 - DNA, 10 bp, Artificial Sequence
  synthetic Reed-Solomon code for 8+2 base, 1 base error, 2 nocall correction
ttccaataac

SEQ ID NO: 784 - DNA, 10 bp, Artificial Sequence
  synthetic Reed-Solomon code for 8+2 base, 1 base error, 2 nocall correction
gggcaatact

SEQ ID NO: 785 - DNA, 10 bp, Artificial Sequence
  synthetic Reed-Solomon code for 8+2 base, 1 base error, 2 nocall correction
agtcaataaa

SEQ ID NO: 786 - DNA, 10 bp, Artificial Sequence
  synthetic Reed-Solomon code for 8+2 base, 1 base error, 2 nocall correction
tgtcaatacg

SEQ ID NO: 787 - DNA, 10 bp, Artificial Sequence
  synthetic Reed-Solomon code for 8+2 base, 1 base error, 2 nocall correction
cttcaataat

SEQ ID NO: 788 - DNA, 10 bp, Artificial Sequence
  synthetic Reed-Solomon code for 8+2 base, 1 base error, 2 nocall correction
ggagaatata

SEQ ID NO: 789 - DNA, 10 bp, Artificial Sequence
  synthetic Reed-Solomon code for 8+2 base, 1 base error, 2 nocall correction
gccgaatagt

SEQ ID NO: 790 - DNA, 10 bp, Artificial Sequence
  synthetic Reed-Solomon code for 8+2 base, 1 base error, 2 nocall correction
agggaatatg

SEQ ID NO: 791 - DNA, 10 bp, Artificial Sequence
  synthetic Reed-Solomon code for 8+2 base, 1 base error, 2 nocall correction
gattaataac

SEQ ID NO: 792 - DNA, 10 bp, Artificial Sequence
  synthetic Reed-Solomon code for 8+2 base, 1 base error, 2 nocall correction
atttaatagg

SEQ ID NO: 793 - DNA, 10 bp, Artificial Sequence
  synthetic Reed-Solomon code for 8+2 base, 1 base error, 2 nocall correction
ataacatacg

SEQ ID NO: 794 - DNA, 10 bp, Artificial Sequence
  synthetic Reed-Solomon code for 8+2 base, 1 base error, 2 nocall correction
ttaacataaa

SEQ ID NO: 795 - DNA, 10 bp, Artificial Sequence
  synthetic Reed-Solomon code for 8+2 base, 1 base error, 2 nocall correction
tagacatagc

SEQ ID NO: 796 - DNA, 10 bp, Artificial Sequence
  synthetic Reed-Solomon code for 8+2 base, 1 base error, 2 nocall correction
gtgacataca

SEQ ID NO: 797 - DNA, 10 bp, Artificial Sequence
  synthetic Reed-Solomon code for 8+2 base, 1 base error, 2 nocall correction
cgtacataaa

SEQ ID NO: 798 - DNA, 10 bp, Artificial Sequence
  synthetic Reed-Solomon code for 8+2 base, 1 base error, 2 nocall correction
attacataat

SEQ ID NO: 799 - DNA, 10 bp, Artificial Sequence
  synthetic Reed-Solomon code for 8+2 base, 1 base error, 2 nocall correction
gccccatagc

SEQ ID NO: 800 - DNA, 10 bp, Artificial Sequence
  synthetic Reed-Solomon code for 8+2 base, 1 base error, 2 nocall correction
gtcccatata

SEQ ID NO: 801 - DNA, 10 bp, Artificial Sequence
  synthetic Reed-Solomon code for 8+2 base, 1 base error, 2 nocall correction
ccgccatagg

SEQ ID NO: 802 - DNA, 10 bp, Artificial Sequence
  synthetic Reed-Solomon code for 8+2 base, 1 base error, 2 nocall correction
tgagcataac

SEQ ID NO: 803 - DNA, 10 bp, Artificial Sequence
  synthetic Reed-Solomon code for 8+2 base, 1 base error, 2 nocall correction
cgcgcatacg

SEQ ID NO: 804 - DNA, 10 bp, Artificial Sequence
  synthetic Reed-Solomon code for 8+2 base, 1 base error, 2 nocall correction
ttcgcataat

SEQ ID NO: 805 - DNA, 10 bp, Artificial Sequence
  synthetic Reed-Solomon code for 8+2 base, 1 base error, 2 nocall correction
ggggcatacc

SEQ ID NO: 806 - DNA, 10 bp, Artificial Sequence
  synthetic Reed-Solomon code for 8+2 base, 1 base error, 2 nocall correction
cttgcataac

SEQ ID NO: 807 - DNA, 10 bp, Artificial Sequence
  synthetic Reed-Solomon code for 8+2 base, 1 base error, 2 nocall correction
aaatcatatt

SEQ ID NO: 808 - DNA, 10 bp, Artificial Sequence
  synthetic Reed-Solomon code for 8+2 base, 1 base error, 2 nocall correction
acgtcataat

SEQ ID NO: 809 - DNA, 10 bp, Artificial Sequence
  synthetic Reed-Solomon code for 8+2 base, 1 base error, 2 nocall correction
tattcatata

SEQ ID NO: 810 - DNA, 10 bp, Artificial Sequence
  synthetic Reed-Solomon code for 8+2 base, 1 base error, 2 nocall correction
gcttcataca

SEQ ID NO: 811 - DNA, 10 bp, Artificial Sequence
  synthetic Reed-Solomon code for 8+2 base, 1 base error, 2 nocall correction
agaagatata

SEQ ID NO: 812 - DNA, 10 bp, Artificial Sequence
  synthetic Reed-Solomon code for 8+2 base, 1 base error, 2 nocall correction
ctaagatatt

SEQ ID NO: 813 - DNA, 10 bp, Artificial Sequence
  synthetic Reed-Solomon code for 8+2 base, 1 base error, 2 nocall correction
accagatagt

SEQ ID NO: 814 - DNA, 10 bp, Artificial Sequence
  synthetic Reed-Solomon code for 8+2 base, 1 base error, 2 nocall correction
cgcagatatc

SEQ ID NO: 815 - DNA, 10 bp, Artificial Sequence
  synthetic Reed-Solomon code for 8+2 base, 1 base error, 2 nocall correction
gggagatatg

SEQ ID NO: 816 - DNA, 10 bp, Artificial Sequence
  synthetic Reed-Solomon code for 8+2 base, 1 base error, 2 nocall correction
tgtagatatt

SEQ ID NO: 817 - DNA, 10 bp, Artificial Sequence
  synthetic Reed-Solomon code for 8+2 base, 1 base error, 2 nocall correction
ggccgatacg

SEQ ID NO: 818 - DNA, 10 bp, Artificial Sequence
  synthetic Reed-Solomon code for 8+2 base, 1 base error, 2 nocall correction
cggcgatacc

SEQ ID NO: 819 - DNA, 10 bp, Artificial Sequence
  synthetic Reed-Solomon code for 8+2 base, 1 base error, 2 nocall correction
aatcgatagg

SEQ ID NO: 820 - DNA, 10 bp, Artificial Sequence
  synthetic Reed-Solomon code for 8+2 base, 1 base error, 2 nocall correction
gttcgataac

SEQ ID NO: 821 - DNA, 10 bp, Artificial Sequence
  synthetic Reed-Solomon code for 8+2 base, 1 base error, 2 nocall correction
acaggataga

SEQ ID NO: 822 - DNA, 10 bp, Artificial Sequence
  synthetic Reed-Solomon code for 8+2 base, 1 base error, 2 nocall correction
ataggatatc

SEQ ID NO: 823 - DNA, 10 bp, Artificial Sequence
  synthetic Reed-Solomon code for 8+2 base, 1 base error, 2 nocall correction
cccggatagc

SEQ ID NO: 824 - DNA, 10 bp, Artificial Sequence
  synthetic Reed-Solomon code for 8+2 base, 1 base error, 2 nocall correction
agcggatatt

SEQ ID NO: 825 - DNA, 10 bp, Artificial Sequence
  synthetic Reed-Solomon code for 8+2 base, 1 base error, 2 nocall correction
ctcggatata

SEQ ID NO: 826 - DNA, 10 bp, Artificial Sequence
  synthetic Reed-Solomon code for 8+2 base, 1 base error, 2 nocall correction
gcgggatagg

SEQ ID NO: 827 - DNA, 10 bp, Artificial Sequence
  synthetic Reed-Solomon code for 8+2 base, 1 base error, 2 nocall correction
tctggatagt

SEQ ID NO: 828 - DNA, 10 bp, Artificial Sequence
  synthetic Reed-Solomon code for 8+2 base, 1 base error, 2 nocall correction
caatgatacg

SEQ ID NO: 829 - DNA, 10 bp, Artificial Sequence
  synthetic Reed-Solomon code for 8+2 base, 1 base error, 2 nocall correction
tactgataac

SEQ ID NO: 830 - DNA, 10 bp, Artificial Sequence
  synthetic Reed-Solomon code for 8+2 base, 1 base error, 2 nocall correction
cattgataat

SEQ ID NO: 831 - DNA, 10 bp, Artificial Sequence
  synthetic Reed-Solomon code for 8+2 base, 1 base error, 2 nocall correction
cgaatatagg

SEQ ID NO: 832 - DNA, 10 bp, Artificial Sequence
  synthetic Reed-Solomon code for 8+2 base, 1 base error, 2 nocall correction
gtgatatagt

SEQ ID NO: 833 - DNA, 10 bp, Artificial Sequence
  synthetic Reed-Solomon code for 8+2 base, 1 base error, 2 nocall correction
tttatatagg

SEQ ID NO: 834 - DNA, 10 bp, Artificial Sequence
  synthetic Reed-Solomon code for 8+2 base, 1 base error, 2 nocall correction
catctatata

SEQ ID NO: 835 - DNA, 10 bp, Artificial Sequence
  synthetic Reed-Solomon code for 8+2 base, 1 base error, 2 nocall correction
ccagtatatg

SEQ ID NO: 836 - DNA, 10 bp, Artificial Sequence
  synthetic Reed-Solomon code for 8+2 base, 1 base error, 2 nocall correction
gacgtataac

SEQ ID NO: 837 - DNA, 10 bp, Artificial Sequence
  synthetic Reed-Solomon code for 8+2 base, 1 base error, 2 nocall correction
atcgtatagg

SEQ ID NO: 838 - DNA, 10 bp, Artificial Sequence
  synthetic Reed-Solomon code for 8+2 base, 1 base error, 2 nocall correction
caggtataag

SEQ ID NO: 839 - DNA, 10 bp, Artificial Sequence
  synthetic Reed-Solomon code for 8+2 base, 1 base error, 2 nocall correction
tcgttatagg

SEQ ID NO: 840 - DNA, 10 bp, Artificial Sequence
  synthetic Reed-Solomon code for 8+2 base, 1 base error, 2 nocall correction
gctttatagt

SEQ ID NO: 841 - DNA, 10 bp, Artificial Sequence
  synthetic Reed-Solomon code for 8+2 base, 1 base error, 2 nocall correction
tcgaactagc

SEQ ID NO: 842 - DNA, 10 bp, Artificial Sequence
  synthetic Reed-Solomon code for 8+2 base, 1 base error, 2 nocall correction
ttgaactata

SEQ ID NO: 843 - DNA, 10 bp, Artificial Sequence
  synthetic Reed-Solomon code for 8+2 base, 1 base error, 2 nocall correction
gaccactagc

SEQ ID NO: 844 - DNA, 10 bp, Artificial Sequence
  synthetic Reed-Solomon code for 8+2 base, 1 base error, 2 nocall correction
atccactaag

SEQ ID NO: 845 - DNA, 10 bp, Artificial Sequence
  synthetic Reed-Solomon code for 8+2 base, 1 base error, 2 nocall correction
ttccactaca

SEQ ID NO: 846 - DNA, 10 bp, Artificial Sequence
  synthetic Reed-Solomon code for 8+2 base, 1 base error, 2 nocall correction
cagcactagg

SEQ ID NO: 847 - DNA, 10 bp, Artificial Sequence
  synthetic Reed-Solomon code for 8+2 base, 1 base error, 2 nocall correction
agtcactacc

SEQ ID NO: 848 - DNA, 10 bp, Artificial Sequence
  synthetic Reed-Solomon code for 8+2 base, 1 base error, 2 nocall correction
tgggactatc

SEQ ID NO: 849 - DNA, 10 bp, Artificial Sequence
  synthetic Reed-Solomon code for 8+2 base, 1 base error, 2 nocall correction
acatactatt

SEQ ID NO: 850 - DNA, 10 bp, Artificial Sequence
  synthetic Reed-Solomon code for 8+2 base, 1 base error, 2 nocall correction
cgatactagc

SEQ ID NO: 851 - DNA, 10 bp, Artificial Sequence
  synthetic Reed-Solomon code for 8+2 base, 1 base error, 2 nocall correction
agctactaga

SEQ ID NO: 852 - DNA, 10 bp, Artificial Sequence
  synthetic Reed-Solomon code for 8+2 base, 1 base error, 2 nocall correction
ctctactagt

SEQ ID NO: 853 - DNA, 10 bp, Artificial Sequence
  synthetic Reed-Solomon code for 8+2 base, 1 base error, 2 nocall correction
aagtactaat

SEQ ID NO: 854 - DNA, 10 bp, Artificial Sequence
  synthetic Reed-Solomon code for 8+2 base, 1 base error, 2 nocall correction
gattactaca

SEQ ID NO: 855 - DNA, 10 bp, Artificial Sequence
  synthetic Reed-Solomon code for 8+2 base, 1 base error, 2 nocall correction
tcttactata

SEQ ID NO: 856 - DNA, 10 bp, Artificial Sequence
  synthetic Reed-Solomon code for 8+2 base, 1 base error, 2 nocall correction
ttttactagc

SEQ ID NO: 857 - DNA, 10 bp, Artificial Sequence
  synthetic Reed-Solomon code for 8+2 base, 1 base error, 2 nocall correction
gaaacctaga

SEQ ID NO: 858 - DNA, 10 bp, Artificial Sequence
  synthetic Reed-Solomon code for 8+2 base, 1 base error, 2 nocall correction
ttaacctacc

SEQ ID NO: 859 - DNA, 10 bp, Artificial Sequence
  synthetic Reed-Solomon code for 8+2 base, 1 base error, 2 nocall correction
tgcacctact

SEQ ID NO: 860 - DNA, 10 bp, Artificial Sequence
  synthetic Reed-Solomon code for 8+2 base, 1 base error, 2 nocall correction
ctcacctaag

SEQ ID NO: 861 - DNA, 10 bp, Artificial Sequence
  synthetic Reed-Solomon code for 8+2 base, 1 base error, 2 nocall correction
aagacctagg

SEQ ID NO: 862 - DNA, 10 bp, Artificial Sequence
  synthetic Reed-Solomon code for 8+2 base, 1 base error, 2 nocall correction
gtgacctaac

SEQ ID NO: 863 - DNA, 10 bp, Artificial Sequence
  synthetic Reed-Solomon code for 8+2 base, 1 base error, 2 nocall correction
cgtacctacc

SEQ ID NO: 864 - DNA, 10 bp, Artificial Sequence
  synthetic Reed-Solomon code for 8+2 base, 1 base error, 2 nocall correction
tggccctatt

SEQ ID NO: 865 - DNA, 10 bp, Artificial Sequence
  synthetic Reed-Solomon code for 8+2 base, 1 base error, 2 nocall correction
ggtccctatg

SEQ ID NO: 866 - DNA, 10 bp, Artificial Sequence
  synthetic Reed-Solomon code for 8+2 base, 1 base error, 2 nocall correction
agagcctaag

SEQ ID NO: 867 - DNA, 10 bp, Artificial Sequence
  synthetic Reed-Solomon code for 8+2 base, 1 base error, 2 nocall correction
tgagcctaca

SEQ ID NO: 868 - DNA, 10 bp, Artificial Sequence
  synthetic Reed-Solomon code for 8+2 base, 1 base error, 2 nocall correction
gacgcctagt

SEQ ID NO: 869 - DNA, 10 bp, Artificial Sequence
  synthetic Reed-Solomon code for 8+2 base, 1 base error, 2 nocall correction
ggggcctaaa

SEQ ID NO: 870 - DNA, 10 bp, Artificial Sequence
  synthetic Reed-Solomon code for 8+2 base, 1 base error, 2 nocall correction
agtgcctact

SEQ ID NO: 871 - DNA, 10 bp, Artificial Sequence
  synthetic Reed-Solomon code for 8+2 base, 1 base error, 2 nocall correction
cttgcctaca

SEQ ID NO: 872 - DNA, 10 bp, Artificial Sequence
  synthetic Reed-Solomon code for 8+2 base, 1 base error, 2 nocall correction
gcttcctaac

SEQ ID NO: 873 - DNA, 10 bp, Artificial Sequence
  synthetic Reed-Solomon code for 8+2 base, 1 base error, 2 nocall correction
cctagctagg

SEQ ID NO: 874 - DNA, 10 bp, Artificial Sequence
  synthetic Reed-Solomon code for 8+2 base, 1 base error, 2 nocall correction
caccgctagt

SEQ ID NO: 875 - DNA, 10 bp, Artificial Sequence
  synthetic Reed-Solomon code for 8+2 base, 1 base error, 2 nocall correction
cggcgctaaa

SEQ ID NO: 876 - DNA, 10 bp, Artificial Sequence
  synthetic Reed-Solomon code for 8+2 base, 1 base error, 2 nocall correction
atgcgctaat

SEQ ID NO: 877 - DNA, 10 bp, Artificial Sequence
  synthetic Reed-Solomon code for 8+2 base, 1 base error, 2 nocall correction
tatcgctagc

SEQ ID NO: 878 - DNA, 10 bp, Artificial Sequence
  synthetic Reed-Solomon code for 8+2 base, 1 base error, 2 nocall correction
gttcgctaca

SEQ ID NO: 879 - DNA, 10 bp, Artificial Sequence
  synthetic Reed-Solomon code for 8+2 base, 1 base error, 2 nocall correction
ttaggctatg

SEQ ID NO: 880 - DNA, 10 bp, Artificial Sequence
  synthetic Reed-Solomon code for 8+2 base, 1 base error, 2 nocall correction
cgtggctatg

SEQ ID NO: 881 - DNA, 10 bp, Artificial Sequence
  synthetic Reed-Solomon code for 8+2 base, 1 base error, 2 nocall correction
ggatgctagt

SEQ ID NO: 882 - DNA, 10 bp, Artificial Sequence
  synthetic Reed-Solomon code for 8+2 base, 1 base error, 2 nocall correction
aactgctaag

SEQ ID NO: 883 - DNA, 10 bp, Artificial Sequence
  synthetic Reed-Solomon code for 8+2 base, 1 base error, 2 nocall correction
tactgctaca

SEQ ID NO: 884 - DNA, 10 bp, Artificial Sequence
  synthetic Reed-Solomon code for 8+2 base, 1 base error, 2 nocall correction
gcctgctata

SEQ ID NO: 885 - DNA, 10 bp, Artificial Sequence
  synthetic Reed-Solomon code for 8+2 base, 1 base error, 2 nocall correction
gtctgctagc

SEQ ID NO: 886 - DNA, 10 bp, Artificial Sequence
  synthetic Reed-Solomon code for 8+2 base, 1 base error, 2 nocall correction
ctgtgctagg

SEQ ID NO: 887 - DNA, 10 bp, Artificial Sequence
  synthetic Reed-Solomon code for 8+2 base, 1 base error, 2 nocall correction
gaaatctact

SEQ ID NO: 888 - DNA, 10 bp, Artificial Sequence
  synthetic Reed-Solomon code for 8+2 base, 1 base error, 2 nocall correction
tcaatctatt

SEQ ID NO: 889 - DNA, 10 bp, Artificial Sequence
  synthetic Reed-Solomon code for 8+2 base, 1 base error, 2 nocall correction
tgcatctaga

SEQ ID NO: 890 - DNA, 10 bp, Artificial Sequence
  synthetic Reed-Solomon code for 8+2 base, 1 base error, 2 nocall correction
tagatctaat

SEQ ID NO: 891 - DNA, 10 bp, Artificial Sequence
  synthetic Reed-Solomon code for 8+2 base, 1 base error, 2 nocall correction
gatatctaag

SEQ ID NO: 892 - DNA, 10 bp, Artificial Sequence
  synthetic Reed-Solomon code for 8+2 base, 1 base error, 2 nocall correction
actatctata

SEQ ID NO: 893 - DNA, 10 bp, Artificial Sequence
  synthetic Reed-Solomon code for 8+2 base, 1 base error, 2 nocall correction
attatctagc

SEQ ID NO: 894 - DNA, 10 bp, Artificial Sequence
  synthetic Reed-Solomon code for 8+2 base, 1 base error, 2 nocall correction
gccctctaat

SEQ ID NO: 895 - DNA, 10 bp, Artificial Sequence
  synthetic Reed-Solomon code for 8+2 base, 1 base error, 2 nocall correction
tgagtctagt

SEQ ID NO: 896 - DNA, 10 bp, Artificial Sequence
  synthetic Reed-Solomon code for 8+2 base, 1 base error, 2 nocall correction
gacgtctaca

SEQ ID NO: 897 - DNA, 10 bp, Artificial Sequence
  synthetic Reed-Solomon code for 8+2 base, 1 base error, 2 nocall correction
tccgtctata

SEQ ID NO: 898 - DNA, 10 bp, Artificial Sequence
  synthetic Reed-Solomon code for 8+2 base, 1 base error, 2 nocall correction
ttcgtctagc

SEQ ID NO: 899 - DNA, 10 bp, Artificial Sequence
  synthetic Reed-Solomon code for 8+2 base, 1 base error, 2 nocall correction
agtgtctaga

SEQ ID NO: 900 - DNA, 10 bp, Artificial Sequence
  synthetic Reed-Solomon code for 8+2 base, 1 base error, 2 nocall correction
cttgtctagt

SEQ ID NO: 901 - DNA, 10 bp, Artificial Sequence
  synthetic Reed-Solomon code for 8+2 base, 1 base error, 2 nocall correction
gtattctatg

SEQ ID NO: 902 - DNA, 10 bp, Artificial Sequence
  synthetic Reed-Solomon code for 8+2 base, 1 base error, 2 nocall correction
acgttctagc

SEQ ID NO: 903 - DNA, 10 bp, Artificial Sequence
  synthetic Reed-Solomon code for 8+2 base, 1 base error, 2 nocall correction
cggttctatt

SEQ ID NO: 904 - DNA, 10 bp, Artificial Sequence
  synthetic Reed-Solomon code for 8+2 base, 1 base error, 2 nocall correction
atgttctata

SEQ ID NO: 905 - DNA, 10 bp, Artificial Sequence
  synthetic Reed-Solomon code for 8+2 base, 1 base error, 2 nocall correction
aaaaagtata

SEQ ID NO: 906 - DNA, 10 bp, Artificial Sequence
  synthetic Reed-Solomon code for 8+2 base, 1 base error, 2 nocall correction
gcaaagtaag

SEQ ID NO: 907 - DNA, 10 bp, Artificial Sequence
  synthetic Reed-Solomon code for 8+2 base, 1 base error, 2 nocall correction
cacaagtatc

SEQ ID NO: 908 - DNA, 10 bp, Artificial Sequence
  synthetic Reed-Solomon code for 8+2 base, 1 base error, 2 nocall correction
gagaagtatg

SEQ ID NO: 909 - DNA, 10 bp, Artificial Sequence
  synthetic Reed-Solomon code for 8+2 base, 1 base error, 2 nocall correction
acgaagtaaa

SEQ ID NO: 910 - DNA, 10 bp, Artificial Sequence
  synthetic Reed-Solomon code for 8+2 base, 1 base error, 2 nocall correction
tcgaagtacg

SEQ ID NO: 911 - DNA, 10 bp, Artificial Sequence
  synthetic Reed-Solomon code for 8+2 base, 1 base error, 2 nocall correction
tataagtatt

SEQ ID NO: 912 - DNA, 10 bp, Artificial Sequence
  synthetic Reed-Solomon code for 8+2 base, 1 base error, 2 nocall correction
gctaagtact

SEQ ID NO: 913 - DNA, 10 bp, Artificial Sequence
  synthetic Reed-Solomon code for 8+2 base, 1 base error, 2 nocall correction
gaccagtacg

SEQ ID NO: 914 - DNA, 10 bp, Artificial Sequence
  synthetic Reed-Solomon code for 8+2 base, 1 base error, 2 nocall correction
tcccagtatg

SEQ ID NO: 915 - DNA, 10 bp, Artificial Sequence
  synthetic Reed-Solomon code for 8+2 base, 1 base error, 2 nocall correction
cagcagtacc

SEQ ID NO: 916 - DNA, 10 bp, Artificial Sequence
  synthetic Reed-Solomon code for 8+2 base, 1 base error, 2 nocall correction
agtcagtagg

SEQ ID NO: 917 - DNA, 10 bp, Artificial Sequence
  synthetic Reed-Solomon code for 8+2 base, 1 base error, 2 nocall correction
aacgagtatt

SEQ ID NO: 918 - DNA, 10 bp, Artificial Sequence
  synthetic Reed-Solomon code for 8+2 base, 1 base error, 2 nocall correction
cgatagtacg

SEQ ID NO: 919 - DNA, 10 bp, Artificial Sequence
  synthetic Reed-Solomon code for 8+2 base, 1 base error, 2 nocall correction
ttatagtaat

SEQ ID NO: 920 - DNA, 10 bp, Artificial Sequence
  synthetic Reed-Solomon code for 8+2 base, 1 base error, 2 nocall correction
tgctagtaac

SEQ ID NO: 921 - DNA, 10 bp, Artificial Sequence
  synthetic Reed-Solomon code for 8+2 base, 1 base error, 2 nocall correction
gtgtagtact

SEQ ID NO: 922 - DNA, 10 bp, Artificial Sequence
  synthetic Reed-Solomon code for 8+2 base, 1 base error, 2 nocall correction
cgttagtaat

SEQ ID NO: 923 - DNA, 10 bp, Artificial Sequence
  synthetic Reed-Solomon code for 8+2 base, 1 base error, 2 nocall correction
atttagtaaa

SEQ ID NO: 924 - DNA, 10 bp, Artificial Sequence
  synthetic Reed-Solomon code for 8+2 base, 1 base error, 2 nocall correction
ttttagtacg

SEQ ID NO: 925 - DNA, 10 bp, Artificial Sequence
  synthetic Reed-Solomon code for 8+2 base, 1 base error, 2 nocall correction
ttaacgtagg

SEQ ID NO: 926 - DNA, 10 bp, Artificial Sequence
  synthetic Reed-Solomon code for 8+2 base, 1 base error, 2 nocall correction
aagacgtacc

SEQ ID NO: 927 - DNA, 10 bp, Artificial Sequence
  synthetic Reed-Solomon code for 8+2 base, 1 base error, 2 nocall correction
cgtacgtagg

SEQ ID NO: 928 - DNA, 10 bp, Artificial Sequence
  synthetic Reed-Solomon code for 8+2 base, 1 base error, 2 nocall correction
caaccgtata

SEQ ID NO: 929 - DNA, 10 bp, Artificial Sequence
  synthetic Reed-Solomon code for 8+2 base, 1 base error, 2 nocall correction
aacccgtatc

SEQ ID NO: 930 - DNA, 10 bp, Artificial Sequence
  synthetic Reed-Solomon code for 8+2 base, 1 base error, 2 nocall correction
ccgccgtaaa

SEQ ID NO: 931 - DNA, 10 bp, Artificial Sequence
  synthetic Reed-Solomon code for 8+2 base, 1 base error, 2 nocall correction
caggcgtact

SEQ ID NO: 932 - DNA, 10 bp, Artificial Sequence
  synthetic Reed-Solomon code for 8+2 base, 1 base error, 2 nocall correction
cctgcgtatg

SEQ ID NO: 933 - DNA, 10 bp, Artificial Sequence
  synthetic Reed-Solomon code for 8+2 base, 1 base error, 2 nocall correction
gcatcgtagt

SEQ ID NO: 934 - DNA, 10 bp, Artificial Sequence
  synthetic Reed-Solomon code for 8+2 base, 1 base error, 2 nocall correction
ggctcgtata

SEQ ID NO: 935 - DNA, 10 bp, Artificial Sequence
  synthetic Reed-Solomon code for 8+2 base, 1 base error, 2 nocall correction
gacaggtatt

SEQ ID NO: 936 - DNA, 10 bp, Artificial Sequence
  synthetic Reed-Solomon code for 8+2 base, 1 base error, 2 nocall correction
tccaggtact

SEQ ID NO: 937 - DNA, 10 bp, Artificial Sequence
  synthetic Reed-Solomon code for 8+2 base, 1 base error, 2 nocall correction
cctaggtacc

SEQ ID NO: 938 - DNA, 10 bp, Artificial Sequence
  synthetic Reed-Solomon code for 8+2 base, 1 base error, 2 nocall correction
taacggtaat

SEQ ID NO: 939 - DNA, 10 bp, Artificial Sequence
  synthetic Reed-Solomon code for 8+2 base, 1 base error, 2 nocall correction
gagcggtact

SEQ ID NO: 940 - DNA, 10 bp, Artificial Sequence
  synthetic Reed-Solomon code for 8+2 base, 1 base error, 2 nocall correction
tcgcggtatt

SEQ ID NO: 941 - DNA, 10 bp, Artificial Sequence
  synthetic Reed-Solomon code for 8+2 base, 1 base error, 2 nocall correction
aatcggtaaa

SEQ ID NO: 942 - DNA, 10 bp, Artificial Sequence
  synthetic Reed-Solomon code for 8+2 base, 1 base error, 2 nocall correction
tatcggtacg

SEQ ID NO: 943 - DNA, 10 bp, Artificial Sequence
  synthetic Reed-Solomon code for 8+2 base, 1 base error, 2 nocall correction
gctcggtatg

SEQ ID NO: 944 - DNA, 10 bp, Artificial Sequence
  synthetic Reed-Solomon code for 8+2 base, 1 base error, 2 nocall correction
gaagggtata

SEQ ID NO: 945 - DNA, 10 bp, Artificial Sequence
  synthetic Reed-Solomon code for 8+2 base, 1 base error, 2 nocall correction
acagggtaag

SEQ ID NO: 946 - DNA, 10 bp, Artificial Sequence
  synthetic Reed-Solomon code for 8+2 base, 1 base error, 2 nocall correction
tcagggtaca

SEQ ID NO: 947 - DNA, 10 bp, Artificial Sequence
  synthetic Reed-Solomon code for 8+2 base, 1 base error, 2 nocall correction
aaggggtatg

SEQ ID NO: 948 - DNA, 10 bp, Artificial Sequence
  synthetic Reed-Solomon code for 8+2 base, 1 base error, 2 nocall correction
gcggggtaaa

SEQ ID NO: 949 - DNA, 10 bp, Artificial Sequence
  synthetic Reed-Solomon code for 8+2 base, 1 base error, 2 nocall correction
actgggtact

SEQ ID NO: 950 - DNA, 10 bp, Artificial Sequence
  synthetic Reed-Solomon code for 8+2 base, 1 base error, 2 nocall correction
gtctggtacg

SEQ ID NO: 951 - DNA, 10 bp, Artificial Sequence
  synthetic Reed-Solomon code for 8+2 base, 1 base error, 2 nocall correction
ctgtggtacc

SEQ ID NO: 952 - DNA, 10 bp, Artificial Sequence
  synthetic Reed-Solomon code for 8+2 base, 1 base error, 2 nocall correction
ggttggtaac

SEQ ID NO: 953 - DNA, 10 bp, Artificial Sequence
  synthetic Reed-Solomon code for 8+2 base, 1 base error, 2 nocall correction
cgaatgtaaa

SEQ ID NO: 954 - DNA, 10 bp, Artificial Sequence
  synthetic Reed-Solomon code for 8+2 base, 1 base error, 2 nocall correction
ataatgtaat

SEQ ID NO: 955 - DNA, 10 bp, Artificial Sequence
  synthetic Reed-Solomon code for 8+2 base, 1 base error, 2 nocall correction
agcatgtaac

SEQ ID NO: 956 - DNA, 10 bp, Artificial Sequence
  synthetic Reed-Solomon code for 8+2 base, 1 base error, 2 nocall correction
attatgtacg

SEQ ID NO: 957 - DNA, 10 bp, Artificial Sequence
  synthetic Reed-Solomon code for 8+2 base, 1 base error, 2 nocall correction
tttatgtaaa

SEQ ID NO: 958 - DNA, 10 bp, Artificial Sequence
  synthetic Reed-Solomon code for 8+2 base, 1 base error, 2 nocall correction
ctagtgtaac

SEQ ID NO: 959 - DNA, 10 bp, Artificial Sequence
  synthetic Reed-Solomon code for 8+2 base, 1 base error, 2 nocall correction
cgcgtgtaat

SEQ ID NO: 960 - DNA, 10 bp, Artificial Sequence
  synthetic Reed-Solomon code for 8+2 base, 1 base error, 2 nocall correction
atcgtgtaaa

SEQ ID NO: 961 - DNA, 10 bp, Artificial Sequence
  synthetic Reed-Solomon code for 8+2 base, 1 base error, 2 nocall correction
ttcgtgtacg

SEQ ID NO: 962 - DNA, 10 bp, Artificial Sequence
  synthetic Reed-Solomon code for 8+2 base, 1 base error, 2 nocall correction
caggtgtaga

SEQ ID NO: 963 - DNA, 10 bp, Artificial Sequence
  synthetic Reed-Solomon code for 8+2 base, 1 base error, 2 nocall correction
tgtgtgtaac

SEQ ID NO: 964 - DNA, 10 bp, Artificial Sequence
  synthetic Reed-Solomon code for 8+2 base, 1 base error, 2 nocall correction
taattgtata

SEQ ID NO: 965 - DNA, 10 bp, Artificial Sequence
  synthetic Reed-Solomon code for 8+2 base, 1 base error, 2 nocall correction
gcattgtaca

SEQ ID NO: 966 - DNA, 10 bp, Artificial Sequence
  synthetic Reed-Solomon code for 8+2 base, 1 base error, 2 nocall correction
acgttgtacg

SEQ ID NO: 967 - DNA, 10 bp, Artificial Sequence
  synthetic Reed-Solomon code for 8+2 base, 1 base error, 2 nocall correction
tcgttgtaaa

SEQ ID NO: 968 - DNA, 10 bp, Artificial Sequence
  synthetic Reed-Solomon code for 8+2 base, 1 base error, 2 nocall correction
aatttgtatt

SEQ ID NO: 969 - DNA, 10 bp, Artificial Sequence
  synthetic Reed-Solomon code for 8+2 base, 1 base error, 2 nocall correction
ggcaattaaa

SEQ ID NO: 970 - DNA, 10 bp, Artificial Sequence
  synthetic Reed-Solomon code for 8+2 base, 1 base error, 2 nocall correction
gagaattagt

SEQ ID NO: 971 - DNA, 10 bp, Artificial Sequence
  synthetic Reed-Solomon code for 8+2 base, 1 base error, 2 nocall correction
tataattagg

SEQ ID NO: 972 - DNA, 10 bp, Artificial Sequence
  synthetic Reed-Solomon code for 8+2 base, 1 base error, 2 nocall correction
tgacattata

SEQ ID NO: 973 - DNA, 10 bp, Artificial Sequence
  synthetic Reed-Solomon code for 8+2 base, 1 base error, 2 nocall correction
tcccattagt

SEQ ID NO: 974 - DNA, 10 bp, Artificial Sequence
  synthetic Reed-Solomon code for 8+2 base, 1 base error, 2 nocall correction
cctcattagc

SEQ ID NO: 975 - DNA, 10 bp, Artificial Sequence
  synthetic Reed-Solomon code for 8+2 base, 1 base error, 2 nocall correction
agtcattatt

SEQ ID NO: 976 - DNA, 10 bp, Artificial Sequence
  synthetic Reed-Solomon code for 8+2 base, 1 base error, 2 nocall correction
cttcattata

SEQ ID NO: 977 - DNA, 10 bp, Artificial Sequence
  synthetic Reed-Solomon code for 8+2 base, 1 base error, 2 nocall correction
ggagattaat

SEQ ID NO: 978 - DNA, 10 bp, Artificial Sequence
  synthetic Reed-Solomon code for 8+2 base, 1 base error, 2 nocall correction
aacgattagg

SEQ ID NO: 979 - DNA, 10 bp, Artificial Sequence
  synthetic Reed-Solomon code for 8+2 base, 1 base error, 2 nocall correction
gtcgattaac

SEQ ID NO: 980 - DNA, 10 bp, Artificial Sequence
  synthetic Reed-Solomon code for 8+2 base, 1 base error, 2 nocall correction
tgggattact

SEQ ID NO: 981 - DNA, 10 bp, Artificial Sequence
  synthetic Reed-Solomon code for 8+2 base, 1 base error, 2 nocall correction
ctggattaag

SEQ ID NO: 982 - DNA, 10 bp, Artificial Sequence
  synthetic Reed-Solomon code for 8+2 base, 1 base error, 2 nocall correction
ggtgattacg

SEQ ID NO: 983 - DNA, 10 bp, Artificial Sequence
  synthetic Reed-Solomon code for 8+2 base, 1 base error, 2 nocall correction
acatattacc

SEQ ID NO: 984 - DNA, 10 bp, Artificial Sequence
  synthetic Reed-Solomon code for 8+2 base, 1 base error, 2 nocall correction
ccctattaca

SEQ ID NO: 985 - DNA, 10 bp, Artificial Sequence
  synthetic Reed-Solomon code for 8+2 base, 1 base error, 2 nocall correction
ttaacttatt

SEQ ID NO: 986 - DNA, 10 bp, Artificial Sequence
  synthetic Reed-Solomon code for 8+2 base, 1 base error, 2 nocall correction
tgcacttatc

SEQ ID NO: 987 - DNA, 10 bp, Artificial Sequence
  synthetic Reed-Solomon code for 8+2 base, 1 base error, 2 nocall correction
actacttagc

SEQ ID NO: 988 - DNA, 10 bp, Artificial Sequence
  synthetic Reed-Solomon code for 8+2 base, 1 base error, 2 nocall correction
cgtacttatt

SEQ ID NO: 989 - DNA, 10 bp, Artificial Sequence
  synthetic Reed-Solomon code for 8+2 base, 1 base error, 2 nocall correction
attacttata

SEQ ID NO: 990 - DNA, 10 bp, Artificial Sequence
  synthetic Reed-Solomon code for 8+2 base, 1 base error, 2 nocall correction
ggaccttaac

SEQ ID NO: 991 - DNA, 10 bp, Artificial Sequence
  synthetic Reed-Solomon code for 8+2 base, 1 base error, 2 nocall correction
gtcccttaat

SEQ ID NO: 992 - DNA, 10 bp, Artificial Sequence
  synthetic Reed-Solomon code for 8+2 base, 1 base error, 2 nocall correction
tggccttacc

SEQ ID NO: 993 - DNA, 10 bp, Artificial Sequence
  synthetic Reed-Solomon code for 8+2 base, 1 base error, 2 nocall correction
tccgcttagc

SEQ ID NO: 994 - DNA, 10 bp, Artificial Sequence
  synthetic Reed-Solomon code for 8+2 base, 1 base error, 2 nocall correction
ttcgcttata

SEQ ID NO: 995 - DNA, 10 bp, Artificial Sequence
  synthetic Reed-Solomon code for 8+2 base, 1 base error, 2 nocall correction
cctgcttagt

SEQ ID NO: 996 - DNA, 10 bp, Artificial Sequence
  synthetic Reed-Solomon code for 8+2 base, 1 base error, 2 nocall correction
agtgcttatc

SEQ ID NO: 997 - DNA, 10 bp, Artificial Sequence
  synthetic Reed-Solomon code for 8+2 base, 1 base error, 2 nocall correction
aaatcttaaa

SEQ ID NO: 998 - DNA, 10 bp, Artificial Sequence
  synthetic Reed-Solomon code for 8+2 base, 1 base error, 2 nocall correction
taatcttacg

SEQ ID NO: 999 - DNA, 10 bp, Artificial Sequence
  synthetic Reed-Solomon code for 8+2 base, 1 base error, 2 nocall correction
gcatcttatg

SEQ ID NO: 1000 - DNA, 10 bp, Artificial Sequence
  synthetic Reed-Solomon code for 8+2 base, 1 base error, 2 nocall correction
cactcttaac

SEQ ID NO: 1001 - DNA, 10 bp, Artificial Sequence
  synthetic Reed-Solomon code for 8+2 base, 1 base error, 2 nocall correction
gagtcttaag

SEQ ID NO: 1002 - DNA, 10 bp, Artificial Sequence
  synthetic Reed-Solomon code for 8+2 base, 1 base error, 2 nocall correction
acgtcttata

SEQ ID NO: 1003 - DNA, 10 bp, Artificial Sequence
  synthetic Reed-Solomon code for 8+2 base, 1 base error, 2 nocall correction
atgtcttagc

SEQ ID NO: 1004 - DNA, 10 bp, Artificial Sequence
  synthetic Reed-Solomon code for 8+2 base, 1 base error, 2 nocall correction
tattcttaat

SEQ ID NO: 1005 - DNA, 10 bp, Artificial Sequence
  synthetic Reed-Solomon code for 8+2 base, 1 base error, 2 nocall correction
agaagttaat

SEQ ID NO: 1006 - DNA, 10 bp, Artificial Sequence
  synthetic Reed-Solomon code for 8+2 base, 1 base error, 2 nocall correction
ctaagttaaa

SEQ ID NO: 1007 - DNA, 10 bp, Artificial Sequence
  synthetic Reed-Solomon code for 8+2 base, 1 base error, 2 nocall correction
gacagttagg

SEQ ID NO: 1008 - DNA, 10 bp, Artificial Sequence
  synthetic Reed-Solomon code for 8+2 base, 1 base error, 2 nocall correction
atcagttaac

SEQ ID NO: 1009 - DNA, 10 bp, Artificial Sequence
  synthetic Reed-Solomon code for 8+2 base, 1 base error, 2 nocall correction
cagagttagc

SEQ ID NO: 1010 - DNA, 10 bp, Artificial Sequence
  synthetic Reed-Solomon code for 8+2 base, 1 base error, 2 nocall correction
agtagttacg

SEQ ID NO: 1011 - DNA, 10 bp, Artificial Sequence
  synthetic Reed-Solomon code for 8+2 base, 1 base error, 2 nocall correction
tgtagttaaa

SEQ ID NO: 1012 - DNA, 10 bp, Artificial Sequence
  synthetic Reed-Solomon code for 8+2 base, 1 base error, 2 nocall correction
tcgcgttagg

SEQ ID NO: 1013 - DNA, 10 bp, Artificial Sequence
  synthetic Reed-Solomon code for 8+2 base, 1 base error, 2 nocall correction
gctcgttagt

SEQ ID NO: 1014 - DNA, 10 bp, Artificial Sequence
  synthetic Reed-Solomon code for 8+2 base, 1 base error, 2 nocall correction
cgaggttaac

SEQ ID NO: 1015 - DNA, 10 bp, Artificial Sequence
  synthetic Reed-Solomon code for 8+2 base, 1 base error, 2 nocall correction
agcggttaaa

SEQ ID NO: 1016 - DNA, 10 bp, Artificial Sequence
  synthetic Reed-Solomon code for 8+2 base, 1 base error, 2 nocall correction
tgcggttacg

SEQ ID NO: 1017 - DNA, 10 bp, Artificial Sequence
  synthetic Reed-Solomon code for 8+2 base, 1 base error, 2 nocall correction
ctcggttaat

SEQ ID NO: 1018 - DNA, 10 bp, Artificial Sequence
  synthetic Reed-Solomon code for 8+2 base, 1 base error, 2 nocall correction
aagggttagt

SEQ ID NO: 1019 - DNA, 10 bp, Artificial Sequence
  synthetic Reed-Solomon code for 8+2 base, 1 base error, 2 nocall correction
tttggttaac

SEQ ID NO: 1020 - DNA, 10 bp, Artificial Sequence
  synthetic Reed-Solomon code for 8+2 base, 1 base error, 2 nocall correction
cattgttata

SEQ ID NO: 1021 - DNA, 10 bp, Artificial Sequence
  synthetic Reed-Solomon code for 8+2 base, 1 base error, 2 nocall correction
gaaatttatc

SEQ ID NO: 1022 - DNA, 10 bp, Artificial Sequence
  synthetic Reed-Solomon code for 8+2 base, 1 base error, 2 nocall correction
tcaatttacc

SEQ ID NO: 1023 - DNA, 10 bp, Artificial Sequence
  synthetic Reed-Solomon code for 8+2 base, 1 base error, 2 nocall correction
cccatttaag

SEQ ID NO: 1024 - DNA, 10 bp, Artificial Sequence
  synthetic Reed-Solomon code for 8+2 base, 1 base error, 2 nocall correction
gcgatttaac

SEQ ID NO: 1025 - DNA, 10 bp, Artificial Sequence
  synthetic Reed-Solomon code for 8+2 base, 1 base error, 2 nocall correction
caactttacg

SEQ ID NO: 1026 - DNA, 10 bp, Artificial Sequence
  synthetic Reed-Solomon code for 8+2 base, 1 base error, 2 nocall correction
tacctttaac

SEQ ID NO: 1027 - DNA, 10 bp, Artificial Sequence
  synthetic Reed-Solomon code for 8+2 base, 1 base error, 2 nocall correction
catctttaat

SEQ ID NO: 1028 - DNA, 10 bp, Artificial Sequence
  synthetic Reed-Solomon code for 8+2 base, 1 base error, 2 nocall correction
cctgtttaca

SEQ ID NO: 1029 - DNA, 10 bp, Artificial Sequence
  synthetic Reed-Solomon code for 8+2 base, 1 base error, 2 nocall correction
ggcttttacg

SEQ ID NO: 1030 - DNA, 10 bp, Artificial Sequence
  synthetic Reed-Solomon code for 8+2 base, 1 base error, 2 nocall correction
cggttttacc

SEQ ID NO: 1031 - DNA, 10 bp, Artificial Sequence
  synthetic Reed-Solomon code for 8+2 base, 1 base error, 2 nocall correction
aatttttagg

SEQ ID NO: 1032 - DNA, 10 bp, Artificial Sequence
  synthetic Reed-Solomon code for 8+2 base, 1 base error, 2 nocall correction
gttttttaac

SEQ ID NO: 1033 - DNA, 10 bp, Artificial Sequence
  synthetic Reed-Solomon code for 8+2 base, 1 base error, 2 nocall correction
ttaaaaactg

SEQ ID NO: 1034 - DNA, 10 bp, Artificial Sequence
  synthetic Reed-Solomon code for 8+2 base, 1 base error, 2 nocall correction
cgtaaaactg

SEQ ID NO: 1035 - DNA, 10 bp, Artificial Sequence
  synthetic Reed-Solomon code for 8+2 base, 1 base error, 2 nocall correction
caacaaacga

SEQ ID NO: 1036 - DNA, 10 bp, Artificial Sequence
  synthetic Reed-Solomon code for 8+2 base, 1 base error, 2 nocall correction
aaccaaacgc

SEQ ID NO: 1037 - DNA, 10 bp, Artificial Sequence
  synthetic Reed-Solomon code for 8+2 base, 1 base error, 2 nocall correction
gtccaaacag

SEQ ID NO: 1038 - DNA, 10 bp, Artificial Sequence
  synthetic Reed-Solomon code for 8+2 base, 1 base error, 2 nocall correction
ctgcaaacac

SEQ ID NO: 1039 - DNA, 10 bp, Artificial Sequence
  synthetic Reed-Solomon code for 8+2 base, 1 base error, 2 nocall correction
ggtcaaaccc

SEQ ID NO: 1040 - DNA, 10 bp, Artificial Sequence
  synthetic Reed-Solomon code for 8+2 base, 1 base error, 2 nocall correction
cctgaaacgg

SEQ ID NO: 1041 - DNA, 10 bp, Artificial Sequence
  synthetic Reed-Solomon code for 8+2 base, 1 base error, 2 nocall correction
taataaacct

SEQ ID NO: 1042 - DNA, 10 bp, Artificial Sequence
  synthetic Reed-Solomon code for 8+2 base, 1 base error, 2 nocall correction
gcataaactt

SEQ ID NO: 1043 - DNA, 10 bp, Artificial Sequence
  synthetic Reed-Solomon code for 8+2 base, 1 base error, 2 nocall correction
ggctaaacga

SEQ ID NO: 1044 - DNA, 10 bp, Artificial Sequence
  synthetic Reed-Solomon code for 8+2 base, 1 base error, 2 nocall correction
gagtaaacat

SEQ ID NO: 1045 - DNA, 10 bp, Artificial Sequence
  synthetic Reed-Solomon code for 8+2 base, 1 base error, 2 nocall correction
aattaaacca

SEQ ID NO: 1046 - DNA, 10 bp, Artificial Sequence
  synthetic Reed-Solomon code for 8+2 base, 1 base error, 2 nocall correction
tattaaacag

SEQ ID NO: 1047 - DNA, 10 bp, Artificial Sequence
  synthetic Reed-Solomon code for 8+2 base, 1 base error, 2 nocall correction
aaaacaacga

SEQ ID NO: 1048 - DNA, 10 bp, Artificial Sequence
  synthetic Reed-Solomon code for 8+2 base, 1 base error, 2 nocall correction
cacacaacgc

SEQ ID NO: 1049 - DNA, 10 bp, Artificial Sequence
  synthetic Reed-Solomon code for 8+2 base, 1 base error, 2 nocall correction
gagacaacgg

SEQ ID NO: 1050 - DNA, 10 bp, Artificial Sequence
  synthetic Reed-Solomon code for 8+2 base, 1 base error, 2 nocall correction
atgacaacac

SEQ ID NO: 1051 - DNA, 10 bp, Artificial Sequence
  synthetic Reed-Solomon code for 8+2 base, 1 base error, 2 nocall correction
tatacaacgt

SEQ ID NO: 1052 - DNA, 10 bp, Artificial Sequence
  synthetic Reed-Solomon code for 8+2 base, 1 base error, 2 nocall correction
tccccaacgg

SEQ ID NO: 1053 - DNA, 10 bp, Artificial Sequence
  synthetic Reed-Solomon code for 8+2 base, 1 base error, 2 nocall correction
agtccaactg

SEQ ID NO: 1054 - DNA, 10 bp, Artificial Sequence
  synthetic Reed-Solomon code for 8+2 base, 1 base error, 2 nocall correction
ggagcaacag

SEQ ID NO: 1055 - DNA, 10 bp, Artificial Sequence
  synthetic Reed-Solomon code for 8+2 base, 1 base error, 2 nocall correction
aacgcaacgt

SEQ ID NO: 1056 - DNA, 10 bp, Artificial Sequence
  synthetic Reed-Solomon code for 8+2 base, 1 base error, 2 nocall correction
agggcaacaa

SEQ ID NO: 1057 - DNA, 10 bp, Artificial Sequence
  synthetic Reed-Solomon code for 8+2 base, 1 base error, 2 nocall correction
tgggcaaccg

SEQ ID NO: 1058 - DNA, 10 bp, Artificial Sequence
  synthetic Reed-Solomon code for 8+2 base, 1 base error, 2 nocall correction
ctggcaacat

SEQ ID NO: 1059 - DNA, 10 bp, Artificial Sequence
  synthetic Reed-Solomon code for 8+2 base, 1 base error, 2 nocall correction
ggtgcaacct

SEQ ID NO: 1060 - DNA, 10 bp, Artificial Sequence
  synthetic Reed-Solomon code for 8+2 base, 1 base error, 2 nocall correction
acttcaacac

SEQ ID NO: 1061 - DNA, 10 bp, Artificial Sequence
  synthetic Reed-Solomon code for 8+2 base, 1 base error, 2 nocall correction
tggagaactc

SEQ ID NO: 1062 - DNA, 10 bp, Artificial Sequence
  synthetic Reed-Solomon code for 8+2 base, 1 base error, 2 nocall correction
cgacgaacag

SEQ ID NO: 1063 - DNA, 10 bp, Artificial Sequence
  synthetic Reed-Solomon code for 8+2 base, 1 base error, 2 nocall correction
ttacgaacct

SEQ ID NO: 1064 - DNA, 10 bp, Artificial Sequence
  synthetic Reed-Solomon code for 8+2 base, 1 base error, 2 nocall correction
tgccgaaccc

SEQ ID NO: 1065 - DNA, 10 bp, Artificial Sequence
  synthetic Reed-Solomon code for 8+2 base, 1 base error, 2 nocall correction
gtgcgaacat

SEQ ID NO: 1066 - DNA, 10 bp, Artificial Sequence
  synthetic Reed-Solomon code for 8+2 base, 1 base error, 2 nocall correction
cgtcgaacct

SEQ ID NO: 1067 - DNA, 10 bp, Artificial Sequence
  synthetic Reed-Solomon code for 8+2 base, 1 base error, 2 nocall correction
attcgaacca

SEQ ID NO: 1068 - DNA, 10 bp, Artificial Sequence
  synthetic Reed-Solomon code for 8+2 base, 1 base error, 2 nocall correction
tttcgaacag

SEQ ID NO: 1069 - DNA, 10 bp, Artificial Sequence
  synthetic Reed-Solomon code for 8+2 base, 1 base error, 2 nocall correction
tcgggaacgc

SEQ ID NO: 1070 - DNA, 10 bp, Artificial Sequence
  synthetic Reed-Solomon code for 8+2 base, 1 base error, 2 nocall correction
ttgggaacta

SEQ ID NO: 1071 - DNA, 10 bp, Artificial Sequence
  synthetic Reed-Solomon code for 8+2 base, 1 base error, 2 nocall correction
ccatgaactc

SEQ ID NO: 1072 - DNA, 10 bp, Artificial Sequence
  synthetic Reed-Solomon code for 8+2 base, 1 base error, 2 nocall correction
agatgaacgt

SEQ ID NO: 1073 - DNA, 10 bp, Artificial Sequence
  synthetic Reed-Solomon code for 8+2 base, 1 base error, 2 nocall correction
ctatgaacga

SEQ ID NO: 1074 - DNA, 10 bp, Artificial Sequence
  synthetic Reed-Solomon code for 8+2 base, 1 base error, 2 nocall correction
gactgaacag

SEQ ID NO: 1075 - DNA, 10 bp, Artificial Sequence
  synthetic Reed-Solomon code for 8+2 base, 1 base error, 2 nocall correction
acctgaacta

SEQ ID NO: 1076 - DNA, 10 bp, Artificial Sequence
  synthetic Reed-Solomon code for 8+2 base, 1 base error, 2 nocall correction
atctgaacgc

SEQ ID NO: 1077 - DNA, 10 bp, Artificial Sequence
  synthetic Reed-Solomon code for 8+2 base, 1 base error, 2 nocall correction
cagtgaacac

SEQ ID NO: 1078 - DNA, 10 bp, Artificial Sequence
  synthetic Reed-Solomon code for 8+2 base, 1 base error, 2 nocall correction
tgttgaacga

SEQ ID NO: 1079 - DNA, 10 bp, Artificial Sequence
  synthetic Reed-Solomon code for 8+2 base, 1 base error, 2 nocall correction
aaaataacct

SEQ ID NO: 1080 - DNA, 10 bp, Artificial Sequence
  synthetic Reed-Solomon code for 8+2 base, 1 base error, 2 nocall correction
aatataacag

SEQ ID NO: 1081 - DNA, 10 bp, Artificial Sequence
  synthetic Reed-Solomon code for 8+2 base, 1 base error, 2 nocall correction
tatataacca

SEQ ID NO: 1082 - DNA, 10 bp, Artificial Sequence
  synthetic Reed-Solomon code for 8+2 base, 1 base error, 2 nocall correction
gctataacta

SEQ ID NO: 1083 - DNA, 10 bp, Artificial Sequence
  synthetic Reed-Solomon code for 8+2 base, 1 base error, 2 nocall correction
gttataacgc

SEQ ID NO: 1084 - DNA, 10 bp, Artificial Sequence
  synthetic Reed-Solomon code for 8+2 base, 1 base error, 2 nocall correction
accctaacat

SEQ ID NO: 1085 - DNA, 10 bp, Artificial Sequence
  synthetic Reed-Solomon code for 8+2 base, 1 base error, 2 nocall correction
caagtaaccc

SEQ ID NO: 1086 - DNA, 10 bp, Artificial Sequence
  synthetic Reed-Solomon code for 8+2 base, 1 base error, 2 nocall correction
aacgtaacca

SEQ ID NO: 1087 - DNA, 10 bp, Artificial Sequence
  synthetic Reed-Solomon code for 8+2 base, 1 base error, 2 nocall correction
tacgtaacag

SEQ ID NO: 1088 - DNA, 10 bp, Artificial Sequence
  synthetic Reed-Solomon code for 8+2 base, 1 base error, 2 nocall correction
ggtgtaacga

SEQ ID NO: 1089 - DNA, 10 bp, Artificial Sequence
  synthetic Reed-Solomon code for 8+2 base, 1 base error, 2 nocall correction
atattaactg

SEQ ID NO: 1090 - DNA, 10 bp, Artificial Sequence
  synthetic Reed-Solomon code for 8+2 base, 1 base error, 2 nocall correction
cccttaacgg

SEQ ID NO: 1091 - DNA, 10 bp, Artificial Sequence
  synthetic Reed-Solomon code for 8+2 base, 1 base error, 2 nocall correction
gcgttaacgc

SEQ ID NO: 1092 - DNA, 10 bp, Artificial Sequence
  synthetic Reed-Solomon code for 8+2 base, 1 base error, 2 nocall correction
gtgttaacta

SEQ ID NO: 1093 - DNA, 10 bp, Artificial Sequence
  synthetic Reed-Solomon code for 8+2 base, 1 base error, 2 nocall correction
acaaacacga

SEQ ID NO: 1094 - DNA, 10 bp, Artificial Sequence
  synthetic Reed-Solomon code for 8+2 base, 1 base error, 2 nocall correction
ataaacactc

SEQ ID NO: 1095 - DNA, 10 bp, Artificial Sequence
  synthetic Reed-Solomon code for 8+2 base, 1 base error, 2 nocall correction
cccaacacgc

SEQ ID NO: 1096 - DNA, 10 bp, Artificial Sequence
  synthetic Reed-Solomon code for 8+2 base, 1 base error, 2 nocall correction
agcaacactt

SEQ ID NO: 1097 - DNA, 10 bp, Artificial Sequence
  synthetic Reed-Solomon code for 8+2 base, 1 base error, 2 nocall correction
ctcaacacta

SEQ ID NO: 1098 - DNA, 10 bp, Artificial Sequence
  synthetic Reed-Solomon code for 8+2 base, 1 base error, 2 nocall correction
gcgaacacgg

SEQ ID NO: 1099 - DNA, 10 bp, Artificial Sequence
  synthetic Reed-Solomon code for 8+2 base, 1 base error, 2 nocall correction
tctaacacgt

SEQ ID NO: 1100 - DNA, 10 bp, Artificial Sequence
  synthetic Reed-Solomon code for 8+2 base, 1 base error, 2 nocall correction
taccacacgg

SEQ ID NO: 1101 - DNA, 10 bp, Artificial Sequence
  synthetic Reed-Solomon code for 8+2 base, 1 base error, 2 nocall correction
aggcacacct

SEQ ID NO: 1102 - DNA, 10 bp, Artificial Sequence
  synthetic Reed-Solomon code for 8+2 base, 1 base error, 2 nocall correction
ctgcacacca

SEQ ID NO: 1103 - DNA, 10 bp, Artificial Sequence
  synthetic Reed-Solomon code for 8+2 base, 1 base error, 2 nocall correction
ggtcacacaa

SEQ ID NO: 1104 - DNA, 10 bp, Artificial Sequence
  synthetic Reed-Solomon code for 8+2 base, 1 base error, 2 nocall correction
agagacacta

SEQ ID NO: 1105 - DNA, 10 bp, Artificial Sequence
  synthetic Reed-Solomon code for 8+2 base, 1 base error, 2 nocall correction
ctagacactt

SEQ ID NO: 1106 - DNA, 10 bp, Artificial Sequence
  synthetic Reed-Solomon code for 8+2 base, 1 base error, 2 nocall correction
accgacacgt

SEQ ID NO: 1107 - DNA, 10 bp, Artificial Sequence
  synthetic Reed-Solomon code for 8+2 base, 1 base error, 2 nocall correction
cgcgacactc

SEQ ID NO: 1108 - DNA, 10 bp, Artificial Sequence
  synthetic Reed-Solomon code for 8+2 base, 1 base error, 2 nocall correction
ggggacactg

SEQ ID NO: 1109 - DNA, 10 bp, Artificial Sequence
  synthetic Reed-Solomon code for 8+2 base, 1 base error, 2 nocall correction
tgtgacactt

SEQ ID NO: 1110 - DNA, 10 bp, Artificial Sequence
  synthetic Reed-Solomon code for 8+2 base, 1 base error, 2 nocall correction
ttgtacacgt

SEQ ID NO: 1111 - DNA, 10 bp, Artificial Sequence
  synthetic Reed-Solomon code for 8+2 base, 1 base error, 2 nocall correction
aattacacac

SEQ ID NO: 1112 - DNA, 10 bp, Artificial Sequence
  synthetic Reed-Solomon code for 8+2 base, 1 base error, 2 nocall correction
gtttacacgg

SEQ ID NO: 1113 - DNA, 10 bp, Artificial Sequence
  synthetic Reed-Solomon code for 8+2 base, 1 base error, 2 nocall correction
gtaaccaccg

SEQ ID NO: 1114 - DNA, 10 bp, Artificial Sequence
  synthetic Reed-Solomon code for 8+2 base, 1 base error, 2 nocall correction
cggaccacct

SEQ ID NO: 1115 - DNA, 10 bp, Artificial Sequence
  synthetic Reed-Solomon code for 8+2 base, 1 base error, 2 nocall correction
atgaccacca

SEQ ID NO: 1116 - DNA, 10 bp, Artificial Sequence
  synthetic Reed-Solomon code for 8+2 base, 1 base error, 2 nocall correction
ttgaccacag

SEQ ID NO: 1117 - DNA, 10 bp, Artificial Sequence
  synthetic Reed-Solomon code for 8+2 base, 1 base error, 2 nocall correction
gttaccacat

SEQ ID NO: 1118 - DNA, 10 bp, Artificial Sequence
  synthetic Reed-Solomon code for 8+2 base, 1 base error, 2 nocall correction
ccacccacga

SEQ ID NO: 1119 - DNA, 10 bp, Artificial Sequence
  synthetic Reed-Solomon code for 8+2 base, 1 base error, 2 nocall correction
ctacccactc

SEQ ID NO: 1120 - DNA, 10 bp, Artificial Sequence
  synthetic Reed-Solomon code for 8+2 base, 1 base error, 2 nocall correction
acccccacgc

SEQ ID NO: 1121 - DNA, 10 bp, Artificial Sequence
  synthetic Reed-Solomon code for 8+2 base, 1 base error, 2 nocall correction
cgccccactt

SEQ ID NO: 1122 - DNA, 10 bp, Artificial Sequence
  synthetic Reed-Solomon code for 8+2 base, 1 base error, 2 nocall correction
atccccacta

SEQ ID NO: 1123 - DNA, 10 bp, Artificial Sequence
  synthetic Reed-Solomon code for 8+2 base, 1 base error, 2 nocall correction
tgtcccactc

SEQ ID NO: 1124 - DNA, 10 bp, Artificial Sequence
  synthetic Reed-Solomon code for 8+2 base, 1 base error, 2 nocall correction
agggccaccc

SEQ ID NO: 1125 - DNA, 10 bp, Artificial Sequence
  synthetic Reed-Solomon code for 8+2 base, 1 base error, 2 nocall correction
catgccacgg

SEQ ID NO: 1126 - DNA, 10 bp, Artificial Sequence
  synthetic Reed-Solomon code for 8+2 base, 1 base error, 2 nocall correction
gaatccactt

SEQ ID NO: 1127 - DNA, 10 bp, Artificial Sequence
  synthetic Reed-Solomon code for 8+2 base, 1 base error, 2 nocall correction
tcatccacct

SEQ ID NO: 1128 - DNA, 10 bp, Artificial Sequence
  synthetic Reed-Solomon code for 8+2 base, 1 base error, 2 nocall correction
gcgtccacat

SEQ ID NO: 1129 - DNA, 10 bp, Artificial Sequence
  synthetic Reed-Solomon code for 8+2 base, 1 base error, 2 nocall correction
acttccacca

SEQ ID NO: 1130 - DNA, 10 bp, Artificial Sequence
  synthetic Reed-Solomon code for 8+2 base, 1 base error, 2 nocall correction
tcttccacag

SEQ ID NO: 1131 - DNA, 10 bp, Artificial Sequence
  synthetic Reed-Solomon code for 8+2 base, 1 base error, 2 nocall correction
ggaagcacta

SEQ ID NO: 1132 - DNA, 10 bp, Artificial Sequence
  synthetic Reed-Solomon code for 8+2 base, 1 base error, 2 nocall correction
gccagcacgt

SEQ ID NO: 1133 - DNA, 10 bp, Artificial Sequence
  synthetic Reed-Solomon code for 8+2 base, 1 base error, 2 nocall correction
aggagcactg

SEQ ID NO: 1134 - DNA, 10 bp, Artificial Sequence
  synthetic Reed-Solomon code for 8+2 base, 1 base error, 2 nocall correction
agccgcaccg

SEQ ID NO: 1135 - DNA, 10 bp, Artificial Sequence
  synthetic Reed-Solomon code for 8+2 base, 1 base error, 2 nocall correction
tgccgcacaa

SEQ ID NO: 1136 - DNA, 10 bp, Artificial Sequence
  synthetic Reed-Solomon code for 8+2 base, 1 base error, 2 nocall correction
tagcgcacgt

SEQ ID NO: 1137 - DNA, 10 bp, Artificial Sequence
  synthetic Reed-Solomon code for 8+2 base, 1 base error, 2 nocall correction
gatcgcacgg

SEQ ID NO: 1138 - DNA, 10 bp, Artificial Sequence
  synthetic Reed-Solomon code for 8+2 base, 1 base error, 2 nocall correction
attcgcacac

SEQ ID NO: 1139 - DNA, 10 bp, Artificial Sequence
  synthetic Reed-Solomon code for 8+2 base, 1 base error, 2 nocall correction
gcaggcacga

SEQ ID NO: 1140 - DNA, 10 bp, Artificial Sequence
  synthetic Reed-Solomon code for 8+2 base, 1 base error, 2 nocall correction
gtaggcactc

SEQ ID NO: 1141 - DNA, 10 bp, Artificial Sequence
  synthetic Reed-Solomon code for 8+2 base, 1 base error, 2 nocall correction
ggcggcactt

SEQ ID NO: 1142 - DNA, 10 bp, Artificial Sequence
  synthetic Reed-Solomon code for 8+2 base, 1 base error, 2 nocall correction
acgggcacgg

SEQ ID NO: 1143 - DNA, 10 bp, Artificial Sequence
  synthetic Reed-Solomon code for 8+2 base, 1 base error, 2 nocall correction
ttctgcacgg

SEQ ID NO: 1144 - DNA, 10 bp, Artificial Sequence
  synthetic Reed-Solomon code for 8+2 base, 1 base error, 2 nocall correction
cagtgcacca

SEQ ID NO: 1145 - DNA, 10 bp, Artificial Sequence
  synthetic Reed-Solomon code for 8+2 base, 1 base error, 2 nocall correction
cacatcacat

SEQ ID NO: 1146 - DNA, 10 bp, Artificial Sequence
  synthetic Reed-Solomon code for 8+2 base, 1 base error, 2 nocall correction
cggatcacga

SEQ ID NO: 1147 - DNA, 10 bp, Artificial Sequence
  synthetic Reed-Solomon code for 8+2 base, 1 base error, 2 nocall correction
atgatcacgt

SEQ ID NO: 1148 - DNA, 10 bp, Artificial Sequence
  synthetic Reed-Solomon code for 8+2 base, 1 base error, 2 nocall correction
tatatcacac

SEQ ID NO: 1149 - DNA, 10 bp, Artificial Sequence
  synthetic Reed-Solomon code for 8+2 base, 1 base error, 2 nocall correction
ccactcacct

SEQ ID NO: 1150 - DNA, 10 bp, Artificial Sequence
  synthetic Reed-Solomon code for 8+2 base, 1 base error, 2 nocall correction
cctctcacag

SEQ ID NO: 1151 - DNA, 10 bp, Artificial Sequence
  synthetic Reed-Solomon code for 8+2 base, 1 base error, 2 nocall correction
caagtcacaa

SEQ ID NO: 1152 - DNA, 10 bp, Artificial Sequence
  synthetic Reed-Solomon code for 8+2 base, 1 base error, 2 nocall correction
aacgtcacac

SEQ ID NO: 1153 - DNA, 10 bp, Artificial Sequence
  synthetic Reed-Solomon code for 8+2 base, 1 base error, 2 nocall correction
gtcgtcacgg

SEQ ID NO: 1154 - DNA, 10 bp, Artificial Sequence
  synthetic Reed-Solomon code for 8+2 base, 1 base error, 2 nocall correction
ccggtcacta

SEQ ID NO: 1155 - DNA, 10 bp, Artificial Sequence
  synthetic Reed-Solomon code for 8+2 base, 1 base error, 2 nocall correction
ctggtcacgc

SEQ ID NO: 1156 - DNA, 10 bp, Artificial Sequence
  synthetic Reed-Solomon code for 8+2 base, 1 base error, 2 nocall correction
tcattcacga

SEQ ID NO: 1157 - DNA, 10 bp, Artificial Sequence
  synthetic Reed-Solomon code for 8+2 base, 1 base error, 2 nocall correction
ttattcactc

SEQ ID NO: 1158 - DNA, 10 bp, Artificial Sequence
  synthetic Reed-Solomon code for 8+2 base, 1 base error, 2 nocall correction
tgcttcactt

SEQ ID NO: 1159 - DNA, 10 bp, Artificial Sequence
  synthetic Reed-Solomon code for 8+2 base, 1 base error, 2 nocall correction
actttcacgt

SEQ ID NO: 1160 - DNA, 10 bp, Artificial Sequence
  synthetic Reed-Solomon code for 8+2 base, 1 base error, 2 nocall correction
cgtttcactc

SEQ ID NO: 1161 - DNA, 10 bp, Artificial Sequence
  synthetic Reed-Solomon code for 8+2 base, 1 base error, 2 nocall correction
tcaaagacac

SEQ ID NO: 1162 - DNA, 10 bp, Artificial Sequence
  synthetic Reed-Solomon code for 8+2 base, 1 base error, 2 nocall correction
cccaagaccg

SEQ ID NO: 1163 - DNA, 10 bp, Artificial Sequence
  synthetic Reed-Solomon code for 8+2 base, 1 base error, 2 nocall correction
tagaagactc

SEQ ID NO: 1164 - DNA, 10 bp, Artificial Sequence
  synthetic Reed-Solomon code for 8+2 base, 1 base error, 2 nocall correction
gcgaagaccc

SEQ ID NO: 1165 - DNA, 10 bp, Artificial Sequence
  synthetic Reed-Solomon code for 8+2 base, 1 base error, 2 nocall correction
caacagacag

SEQ ID NO: 1166 - DNA, 10 bp, Artificial Sequence
  synthetic Reed-Solomon code for 8+2 base, 1 base error, 2 nocall correction
taccagaccc

SEQ ID NO: 1167 - DNA, 10 bp, Artificial Sequence
  synthetic Reed-Solomon code for 8+2 base, 1 base error, 2 nocall correction
gcccagactc

SEQ ID NO: 1168 - DNA, 10 bp, Artificial Sequence
  synthetic Reed-Solomon code for 8+2 base, 1 base error, 2 nocall correction
gtccagacga

SEQ ID NO: 1169 - DNA, 10 bp, Artificial Sequence
  synthetic Reed-Solomon code for 8+2 base, 1 base error, 2 nocall correction
ccgcagactg

SEQ ID NO: 1170 - DNA, 10 bp, Artificial Sequence
  synthetic Reed-Solomon code for 8+2 base, 1 base error, 2 nocall correction
catcagacct

SEQ ID NO: 1171 - DNA, 10 bp, Artificial Sequence
  synthetic Reed-Solomon code for 8+2 base, 1 base error, 2 nocall correction
cctgagacaa

SEQ ID NO: 1172 - DNA, 10 bp, Artificial Sequence
  synthetic Reed-Solomon code for 8+2 base, 1 base error, 2 nocall correction
aaatagacgt

SEQ ID NO: 1173 - DNA, 10 bp, Artificial Sequence
  synthetic Reed-Solomon code for 8+2 base, 1 base error, 2 nocall correction
ggctagacag

SEQ ID NO: 1174 - DNA, 10 bp, Artificial Sequence
  synthetic Reed-Solomon code for 8+2 base, 1 base error, 2 nocall correction
cggtagacac

SEQ ID NO: 1175 - DNA, 10 bp, Artificial Sequence
  synthetic Reed-Solomon code for 8+2 base, 1 base error, 2 nocall correction
tattagacga

SEQ ID NO: 1176 - DNA, 10 bp, Artificial Sequence
  synthetic Reed-Solomon code for 8+2 base, 1 base error, 2 nocall correction
gtttagaccc

SEQ ID NO: 1177 - DNA, 10 bp, Artificial Sequence
  synthetic Reed-Solomon code for 8+2 base, 1 base error, 2 nocall correction
aaaacgacag

SEQ ID NO: 1178 - DNA, 10 bp, Artificial Sequence
  synthetic Reed-Solomon code for 8+2 base, 1 base error, 2 nocall correction
taaacgacca

SEQ ID NO: 1179 - DNA, 10 bp, Artificial Sequence
  synthetic Reed-Solomon code for 8+2 base, 1 base error, 2 nocall correction
gcaacgacta

SEQ ID NO: 1180 - DNA, 10 bp, Artificial Sequence
  synthetic Reed-Solomon code for 8+2 base, 1 base error, 2 nocall correction
gtaacgacgc

SEQ ID NO: 1181 - DNA, 10 bp, Artificial Sequence
  synthetic Reed-Solomon code for 8+2 base, 1 base error, 2 nocall correction
ggcacgacgt

SEQ ID NO: 1182 - DNA, 10 bp, Artificial Sequence
  synthetic Reed-Solomon code for 8+2 base, 1 base error, 2 nocall correction
gagacgacaa

SEQ ID NO: 1183 - DNA, 10 bp, Artificial Sequence
  synthetic Reed-Solomon code for 8+2 base, 1 base error, 2 nocall correction
acgacgactg

SEQ ID NO: 1184 - DNA, 10 bp, Artificial Sequence
  synthetic Reed-Solomon code for 8+2 base, 1 base error, 2 nocall correction
aatacgacct

SEQ ID NO: 1185 - DNA, 10 bp, Artificial Sequence
  synthetic Reed-Solomon code for 8+2 base, 1 base error, 2 nocall correction
accccgaccg

SEQ ID NO: 1186 - DNA, 10 bp, Artificial Sequence
  synthetic Reed-Solomon code for 8+2 base, 1 base error, 2 nocall correction
tccccgacaa

SEQ ID NO: 1187 - DNA, 10 bp, Artificial Sequence
  synthetic Reed-Solomon code for 8+2 base, 1 base error, 2 nocall correction
ggagcgacga

SEQ ID NO: 1188 - DNA, 10 bp, Artificial Sequence
  synthetic Reed-Solomon code for 8+2 base, 1 base error, 2 nocall correction
tacgcgacct

SEQ ID NO: 1189 - DNA, 10 bp, Artificial Sequence
  synthetic Reed-Solomon code for 8+2 base, 1 base error, 2 nocall correction
gccgcgactt

SEQ ID NO: 1190 - DNA, 10 bp, Artificial Sequence
  synthetic Reed-Solomon code for 8+2 base, 1 base error, 2 nocall correction
agggcgacgg

SEQ ID NO: 1191 - DNA, 10 bp, Artificial Sequence
  synthetic Reed-Solomon code for 8+2 base, 1 base error, 2 nocall correction
catgcgaccc

SEQ ID NO: 1192 - DNA, 10 bp, Artificial Sequence
  synthetic Reed-Solomon code for 8+2 base, 1 base error, 2 nocall correction
atttcgactg

SEQ ID NO: 1193 - DNA, 10 bp, Artificial Sequence
  synthetic Reed-Solomon code for 8+2 base, 1 base error, 2 nocall correction
ccgaggacct

SEQ ID NO: 1194 - DNA, 10 bp, Artificial Sequence
  synthetic Reed-Solomon code for 8+2 base, 1 base error, 2 nocall correction
cataggactg

SEQ ID NO: 1195 - DNA, 10 bp, Artificial Sequence
  synthetic Reed-Solomon code for 8+2 base, 1 base error, 2 nocall correction
cgacggacga

SEQ ID NO: 1196 - DNA, 10 bp, Artificial Sequence
  synthetic Reed-Solomon code for 8+2 base, 1 base error, 2 nocall correction
atacggacgt

SEQ ID NO: 1197 - DNA, 10 bp, Artificial Sequence
  synthetic Reed-Solomon code for 8+2 base, 1 base error, 2 nocall correction
ccccggactt

SEQ ID NO: 1198 - DNA, 10 bp, Artificial Sequence
  synthetic Reed-Solomon code for 8+2 base, 1 base error, 2 nocall correction
agccggacgc

SEQ ID NO: 1199 - DNA, 10 bp, Artificial Sequence
  synthetic Reed-Solomon code for 8+2 base, 1 base error, 2 nocall correction
gatcggaccc

SEQ ID NO: 1200 - DNA, 10 bp, Artificial Sequence
  synthetic Reed-Solomon code for 8+2 base, 1 base error, 2 nocall correction
tctcggactc

SEQ ID NO: 1201 - DNA, 10 bp, Artificial Sequence
  synthetic Reed-Solomon code for 8+2 base, 1 base error, 2 nocall correction
tttcggacga

SEQ ID NO: 1202 - DNA, 10 bp, Artificial Sequence
  synthetic Reed-Solomon code for 8+2 base, 1 base error, 2 nocall correction
acggggaccc

SEQ ID NO: 1203 - DNA, 10 bp, Artificial Sequence
  synthetic Reed-Solomon code for 8+2 base, 1 base error, 2 nocall correction
tgatggacct

SEQ ID NO: 1204 - DNA, 10 bp, Artificial Sequence
  synthetic Reed-Solomon code for 8+2 base, 1 base error, 2 nocall correction
ctatggacag

SEQ ID NO: 1205 - DNA, 10 bp, Artificial Sequence
  synthetic Reed-Solomon code for 8+2 base, 1 base error, 2 nocall correction
gactggacga

SEQ ID NO: 1206 - DNA, 10 bp, Artificial Sequence
  synthetic Reed-Solomon code for 8+2 base, 1 base error, 2 nocall correction
ttctggaccc

SEQ ID NO: 1207 - DNA, 10 bp, Artificial Sequence
  synthetic Reed-Solomon code for 8+2 base, 1 base error, 2 nocall correction
gggtggacat

SEQ ID NO: 1208 - DNA, 10 bp, Artificial Sequence
  synthetic Reed-Solomon code for 8+2 base, 1 base error, 2 nocall correction
agttggacca

SEQ ID NO: 1209 - DNA, 10 bp, Artificial Sequence
  synthetic Reed-Solomon code for 8+2 base, 1 base error, 2 nocall correction
tgttggacag

SEQ ID NO: 1210 - DNA, 10 bp, Artificial Sequence
  synthetic Reed-Solomon code for 8+2 base, 1 base error, 2 nocall correction
ctttggacct

SEQ ID NO: 1211 - DNA, 10 bp, Artificial Sequence
  synthetic Reed-Solomon code for 8+2 base, 1 base error, 2 nocall correction
taaatgacgt

SEQ ID NO: 1212 - DNA, 10 bp, Artificial Sequence
  synthetic Reed-Solomon code for 8+2 base, 1 base error, 2 nocall correction
ggcatgacca

SEQ ID NO: 1213 - DNA, 10 bp, Artificial Sequence
  synthetic Reed-Solomon code for 8+2 base, 1 base error, 2 nocall correction
aatatgacga

SEQ ID NO: 1214 - DNA, 10 bp, Artificial Sequence
  synthetic Reed-Solomon code for 8+2 base, 1 base error, 2 nocall correction
agactgactg

SEQ ID NO: 1215 - DNA, 10 bp, Artificial Sequence
  synthetic Reed-Solomon code for 8+2 base, 1 base error, 2 nocall correction
gggctgacta

SEQ ID NO: 1216 - DNA, 10 bp, Artificial Sequence
  synthetic Reed-Solomon code for 8+2 base, 1 base error, 2 nocall correction
ggagtgacct

SEQ ID NO: 1217 - DNA, 10 bp, Artificial Sequence
  synthetic Reed-Solomon code for 8+2 base, 1 base error, 2 nocall correction
tacgtgacga

SEQ ID NO: 1218 - DNA, 10 bp, Artificial Sequence
  synthetic Reed-Solomon code for 8+2 base, 1 base error, 2 nocall correction
gtcgtgaccc

SEQ ID NO: 1219 - DNA, 10 bp, Artificial Sequence
  synthetic Reed-Solomon code for 8+2 base, 1 base error, 2 nocall correction
tgggtgacat

SEQ ID NO: 1220 - DNA, 10 bp, Artificial Sequence
  synthetic Reed-Solomon code for 8+2 base, 1 base error, 2 nocall correction
ctggtgaccg

SEQ ID NO: 1221 - DNA, 10 bp, Artificial Sequence
  synthetic Reed-Solomon code for 8+2 base, 1 base error, 2 nocall correction
ggtgtgacag

SEQ ID NO: 1222 - DNA, 10 bp, Artificial Sequence
  synthetic Reed-Solomon code for 8+2 base, 1 base error, 2 nocall correction
acattgacac

SEQ ID NO: 1223 - DNA, 10 bp, Artificial Sequence
  synthetic Reed-Solomon code for 8+2 base, 1 base error, 2 nocall correction
cccttgacaa

SEQ ID NO: 1224 - DNA, 10 bp, Artificial Sequence
  synthetic Reed-Solomon code for 8+2 base, 1 base error, 2 nocall correction
aagttgactc

SEQ ID NO: 1225 - DNA, 10 bp, Artificial Sequence
  synthetic Reed-Solomon code for 8+2 base, 1 base error, 2 nocall correction
cgaaatacca

SEQ ID NO: 1226 - DNA, 10 bp, Artificial Sequence
  synthetic Reed-Solomon code for 8+2 base, 1 base error, 2 nocall correction
ataaatacct

SEQ ID NO: 1227 - DNA, 10 bp, Artificial Sequence
  synthetic Reed-Solomon code for 8+2 base, 1 base error, 2 nocall correction
agcaataccc

SEQ ID NO: 1228 - DNA, 10 bp, Artificial Sequence
  synthetic Reed-Solomon code for 8+2 base, 1 base error, 2 nocall correction
gataatacgc

SEQ ID NO: 1229 - DNA, 10 bp, Artificial Sequence
  synthetic Reed-Solomon code for 8+2 base, 1 base error, 2 nocall correction
attaatacag

SEQ ID NO: 1230 - DNA, 10 bp, Artificial Sequence
  synthetic Reed-Solomon code for 8+2 base, 1 base error, 2 nocall correction
tttaatacca

SEQ ID NO: 1231 - DNA, 10 bp, Artificial Sequence
  synthetic Reed-Solomon code for 8+2 base, 1 base error, 2 nocall correction
ccgcatacgt

SEQ ID NO: 1232 - DNA, 10 bp, Artificial Sequence
  synthetic Reed-Solomon code for 8+2 base, 1 base error, 2 nocall correction
aggcatactc

SEQ ID NO: 1233 - DNA, 10 bp, Artificial Sequence
  synthetic Reed-Solomon code for 8+2 base, 1 base error, 2 nocall correction
ctagataccc

SEQ ID NO: 1234 - DNA, 10 bp, Artificial Sequence
  synthetic Reed-Solomon code for 8+2 base, 1 base error, 2 nocall correction
cgcgatacct

SEQ ID NO: 1235 - DNA, 10 bp, Artificial Sequence
  synthetic Reed-Solomon code for 8+2 base, 1 base error, 2 nocall correction
atcgatacca

SEQ ID NO: 1236 - DNA, 10 bp, Artificial Sequence
  synthetic Reed-Solomon code for 8+2 base, 1 base error, 2 nocall correction
ttcgatacag

SEQ ID NO: 1237 - DNA, 10 bp, Artificial Sequence
  synthetic Reed-Solomon code for 8+2 base, 1 base error, 2 nocall correction
tgtgataccc

SEQ ID NO: 1238 - DNA, 10 bp, Artificial Sequence
  synthetic Reed-Solomon code for 8+2 base, 1 base error, 2 nocall correction
aaatatactg

SEQ ID NO: 1239 - DNA, 10 bp, Artificial Sequence
  synthetic Reed-Solomon code for 8+2 base, 1 base error, 2 nocall correction
gcatatacaa

SEQ ID NO: 1240 - DNA, 10 bp, Artificial Sequence
  synthetic Reed-Solomon code for 8+2 base, 1 base error, 2 nocall correction
gagtatacta

SEQ ID NO: 1241 - DNA, 10 bp, Artificial Sequence
  synthetic Reed-Solomon code for 8+2 base, 1 base error, 2 nocall correction
acgtatacag

SEQ ID NO: 1242 - DNA, 10 bp, Artificial Sequence
  synthetic Reed-Solomon code for 8+2 base, 1 base error, 2 nocall correction
tcgtatacca

SEQ ID NO: 1243 - DNA, 10 bp, Artificial Sequence
  synthetic Reed-Solomon code for 8+2 base, 1 base error, 2 nocall correction
ggcactactg

SEQ ID NO: 1244 - DNA, 10 bp, Artificial Sequence
  synthetic Reed-Solomon code for 8+2 base, 1 base error, 2 nocall correction
acgactacgt

SEQ ID NO: 1245 - DNA, 10 bp, Artificial Sequence
  synthetic Reed-Solomon code for 8+2 base, 1 base error, 2 nocall correction
cggactactc

SEQ ID NO: 1246 - DNA, 10 bp, Artificial Sequence
  synthetic Reed-Solomon code for 8+2 base, 1 base error, 2 nocall correction
agacctacca

SEQ ID NO: 1247 - DNA, 10 bp, Artificial Sequence
  synthetic Reed-Solomon code for 8+2 base, 1 base error, 2 nocall correction
tgacctacag

SEQ ID NO: 1248 - DNA, 10 bp, Artificial Sequence
  synthetic Reed-Solomon code for 8+2 base, 1 base error, 2 nocall correction
ctacctacct

SEQ ID NO: 1249 - DNA, 10 bp, Artificial Sequence
  synthetic Reed-Solomon code for 8+2 base, 1 base error, 2 nocall correction
cgccctaccc

SEQ ID NO: 1250 - DNA, 10 bp, Artificial Sequence
  synthetic Reed-Solomon code for 8+2 base, 1 base error, 2 nocall correction
gggcctaccg

SEQ ID NO: 1251 - DNA, 10 bp, Artificial Sequence
  synthetic Reed-Solomon code for 8+2 base, 1 base error, 2 nocall correction
tgtcctacct

SEQ ID NO: 1252 - DNA, 10 bp, Artificial Sequence
  synthetic Reed-Solomon code for 8+2 base, 1 base error, 2 nocall correction
cttcctacag

SEQ ID NO: 1253 - DNA, 10 bp, Artificial Sequence
  synthetic Reed-Solomon code for 8+2 base, 1 base error, 2 nocall correction
gccgctacgg

SEQ ID NO: 1254 - DNA, 10 bp, Artificial Sequence
  synthetic Reed-Solomon code for 8+2 base, 1 base error, 2 nocall correction
ccggctacgc

SEQ ID NO: 1255 - DNA, 10 bp, Artificial Sequence
  synthetic Reed-Solomon code for 8+2 base, 1 base error, 2 nocall correction
agggctactt

SEQ ID NO: 1256 - DNA, 10 bp, Artificial Sequence
  synthetic Reed-Solomon code for 8+2 base, 1 base error, 2 nocall correction
ctggctacta

SEQ ID NO: 1257 - DNA, 10 bp, Artificial Sequence
  synthetic Reed-Solomon code for 8+2 base, 1 base error, 2 nocall correction
gaatctaccc

SEQ ID NO: 1258 - DNA, 10 bp, Artificial Sequence
  synthetic Reed-Solomon code for 8+2 base, 1 base error, 2 nocall correction
tcatctactc

SEQ ID NO: 1259 - DNA, 10 bp, Artificial Sequence
  synthetic Reed-Solomon code for 8+2 base, 1 base error, 2 nocall correction
ttatctacga

SEQ ID NO: 1260 - DNA, 10 bp, Artificial Sequence
  synthetic Reed-Solomon code for 8+2 base, 1 base error, 2 nocall correction
tagtctacac

SEQ ID NO: 1261 - DNA, 10 bp, Artificial Sequence
  synthetic Reed-Solomon code for 8+2 base, 1 base error, 2 nocall correction
cgttctacga

SEQ ID NO: 1262 - DNA, 10 bp, Artificial Sequence
  synthetic Reed-Solomon code for 8+2 base, 1 base error, 2 nocall correction
atttctacgt

SEQ ID NO: 1263 - DNA, 10 bp, Artificial Sequence
  synthetic Reed-Solomon code for 8+2 base, 1 base error, 2 nocall correction
tacagtacgc

SEQ ID NO: 1264 - DNA, 10 bp, Artificial Sequence
  synthetic Reed-Solomon code for 8+2 base, 1 base error, 2 nocall correction
gtcagtacca

SEQ ID NO: 1265 - DNA, 10 bp, Artificial Sequence
  synthetic Reed-Solomon code for 8+2 base, 1 base error, 2 nocall correction
catagtacgt

SEQ ID NO: 1266 - DNA, 10 bp, Artificial Sequence
  synthetic Reed-Solomon code for 8+2 base, 1 base error, 2 nocall correction
atacgtactg

SEQ ID NO: 1267 - DNA, 10 bp, Artificial Sequence
  synthetic Reed-Solomon code for 8+2 base, 1 base error, 2 nocall correction
ccccgtacgg

SEQ ID NO: 1268 - DNA, 10 bp, Artificial Sequence
  synthetic Reed-Solomon code for 8+2 base, 1 base error, 2 nocall correction
gcgcgtacgc

SEQ ID NO: 1269 - DNA, 10 bp, Artificial Sequence
  synthetic Reed-Solomon code for 8+2 base, 1 base error, 2 nocall correction
gtgcgtacta

SEQ ID NO: 1270 - DNA, 10 bp, Artificial Sequence
  synthetic Reed-Solomon code for 8+2 base, 1 base error, 2 nocall correction
gtaggtacct

SEQ ID NO: 1271 - DNA, 10 bp, Artificial Sequence
  synthetic Reed-Solomon code for 8+2 base, 1 base error, 2 nocall correction
ggcggtaccc

SEQ ID NO: 1272 - DNA, 10 bp, Artificial Sequence
  synthetic Reed-Solomon code for 8+2 base, 1 base error, 2 nocall correction
cggggtaccg

SEQ ID NO: 1273 - DNA, 10 bp, Artificial Sequence
  synthetic Reed-Solomon code for 8+2 base, 1 base error, 2 nocall correction
ttgggtacat

SEQ ID NO: 1274 - DNA, 10 bp, Artificial Sequence
  synthetic Reed-Solomon code for 8+2 base, 1 base error, 2 nocall correction
aatggtacgc

SEQ ID NO: 1275 - DNA, 10 bp, Artificial Sequence
  synthetic Reed-Solomon code for 8+2 base, 1 base error, 2 nocall correction
gttggtacag

SEQ ID NO: 1276 - DNA, 10 bp, Artificial Sequence
  synthetic Reed-Solomon code for 8+2 base, 1 base error, 2 nocall correction
acctgtacat

SEQ ID NO: 1277 - DNA, 10 bp, Artificial Sequence
  synthetic Reed-Solomon code for 8+2 base, 1 base error, 2 nocall correction
taaattactg

SEQ ID NO: 1278 - DNA, 10 bp, Artificial Sequence
  synthetic Reed-Solomon code for 8+2 base, 1 base error, 2 nocall correction
gcaattaccg

SEQ ID NO: 1279 - DNA, 10 bp, Artificial Sequence
  synthetic Reed-Solomon code for 8+2 base, 1 base error, 2 nocall correction
acgattacca

SEQ ID NO: 1280 - DNA, 10 bp, Artificial Sequence
  synthetic Reed-Solomon code for 8+2 base, 1 base error, 2 nocall correction
tcgattacag

SEQ ID NO: 1281 - DNA, 10 bp, Artificial Sequence
  synthetic Reed-Solomon code for 8+2 base, 1 base error, 2 nocall correction
gctattacat

SEQ ID NO: 1282 - DNA, 10 bp, Artificial Sequence
  synthetic Reed-Solomon code for 8+2 base, 1 base error, 2 nocall correction
ccacttactc

SEQ ID NO: 1283 - DNA, 10 bp, Artificial Sequence
  synthetic Reed-Solomon code for 8+2 base, 1 base error, 2 nocall correction
agacttacgt

SEQ ID NO: 1284 - DNA, 10 bp, Artificial Sequence
  synthetic Reed-Solomon code for 8+2 base, 1 base error, 2 nocall correction
ctacttacga

SEQ ID NO: 1285 - DNA, 10 bp, Artificial Sequence
  synthetic Reed-Solomon code for 8+2 base, 1 base error, 2 nocall correction
gaccttacag

SEQ ID NO: 1286 - DNA, 10 bp, Artificial Sequence
  synthetic Reed-Solomon code for 8+2 base, 1 base error, 2 nocall correction
acccttacta

SEQ ID NO: 1287 - DNA, 10 bp, Artificial Sequence
  synthetic Reed-Solomon code for 8+2 base, 1 base error, 2 nocall correction
atccttacgc

SEQ ID NO: 1288 - DNA, 10 bp, Artificial Sequence
  synthetic Reed-Solomon code for 8+2 base, 1 base error, 2 nocall correction
cagcttacac

SEQ ID NO: 1289 - DNA, 10 bp, Artificial Sequence
  synthetic Reed-Solomon code for 8+2 base, 1 base error, 2 nocall correction
tgtcttacga

SEQ ID NO: 1290 - DNA, 10 bp, Artificial Sequence
  synthetic Reed-Solomon code for 8+2 base, 1 base error, 2 nocall correction
cgatttacag

SEQ ID NO: 1291 - DNA, 10 bp, Artificial Sequence
  synthetic Reed-Solomon code for 8+2 base, 1 base error, 2 nocall correction
ttatttacct

SEQ ID NO: 1292 - DNA, 10 bp, Artificial Sequence
  synthetic Reed-Solomon code for 8+2 base, 1 base error, 2 nocall correction
tgctttaccc

SEQ ID NO: 1293 - DNA, 10 bp, Artificial Sequence
  synthetic Reed-Solomon code for 8+2 base, 1 base error, 2 nocall correction
gtgtttacat

SEQ ID NO: 1294 - DNA, 10 bp, Artificial Sequence
  synthetic Reed-Solomon code for 8+2 base, 1 base error, 2 nocall correction
cgttttacct

SEQ ID NO: 1295 - DNA, 10 bp, Artificial Sequence
  synthetic Reed-Solomon code for 8+2 base, 1 base error, 2 nocall correction
atttttacca

SEQ ID NO: 1296 - DNA, 10 bp, Artificial Sequence
  synthetic Reed-Solomon code for 8+2 base, 1 base error, 2 nocall correction
ttttttacag

SEQ ID NO: 1297 - DNA, 10 bp, Artificial Sequence
  synthetic Reed-Solomon code for 8+2 base, 1 base error, 2 nocall correction
ccaaaaccgc

SEQ ID NO: 1298 - DNA, 10 bp, Artificial Sequence
  synthetic Reed-Solomon code for 8+2 base, 1 base error, 2 nocall correction
agaaaacctt

SEQ ID NO: 1299 - DNA, 10 bp, Artificial Sequence
  synthetic Reed-Solomon code for 8+2 base, 1 base error, 2 nocall correction
ctaaaaccta

SEQ ID NO: 1300 - DNA, 10 bp, Artificial Sequence
  synthetic Reed-Solomon code for 8+2 base, 1 base error, 2 nocall correction
accaaaccga

SEQ ID NO: 1301 - DNA, 10 bp, Artificial Sequence
  synthetic Reed-Solomon code for 8+2 base, 1 base error, 2 nocall correction
atcaaacctc

SEQ ID NO: 1302 - DNA, 10 bp, Artificial Sequence
  synthetic Reed-Solomon code for 8+2 base, 1 base error, 2 nocall correction
tgtaaaccta

SEQ ID NO: 1303 - DNA, 10 bp, Artificial Sequence
  synthetic Reed-Solomon code for 8+2 base, 1 base error, 2 nocall correction
taacaaccgg

SEQ ID NO: 1304 - DNA, 10 bp, Artificial Sequence
  synthetic Reed-Solomon code for 8+2 base, 1 base error, 2 nocall correction
atgcaacccc

SEQ ID NO: 1305 - DNA, 10 bp, Artificial Sequence
  synthetic Reed-Solomon code for 8+2 base, 1 base error, 2 nocall correction
acagaaccgt

SEQ ID NO: 1306 - DNA, 10 bp, Artificial Sequence
  synthetic Reed-Solomon code for 8+2 base, 1 base error, 2 nocall correction
cgagaacctc

SEQ ID NO: 1307 - DNA, 10 bp, Artificial Sequence
  synthetic Reed-Solomon code for 8+2 base, 1 base error, 2 nocall correction
agcgaaccta

SEQ ID NO: 1308 - DNA, 10 bp, Artificial Sequence
  synthetic Reed-Solomon code for 8+2 base, 1 base error, 2 nocall correction
ctcgaacctt

SEQ ID NO: 1309 - DNA, 10 bp, Artificial Sequence
  synthetic Reed-Solomon code for 8+2 base, 1 base error, 2 nocall correction
tctgaaccga

SEQ ID NO: 1310 - DNA, 10 bp, Artificial Sequence
  synthetic Reed-Solomon code for 8+2 base, 1 base error, 2 nocall correction
tttgaacctc

SEQ ID NO: 1311 - DNA, 10 bp, Artificial Sequence
  synthetic Reed-Solomon code for 8+2 base, 1 base error, 2 nocall correction
tggtaaccgc

SEQ ID NO: 1312 - DNA, 10 bp, Artificial Sequence
  synthetic Reed-Solomon code for 8+2 base, 1 base error, 2 nocall correction
cattaaccaa

SEQ ID NO: 1313 - DNA, 10 bp, Artificial Sequence
  synthetic Reed-Solomon code for 8+2 base, 1 base error, 2 nocall correction
gtcacacccg

SEQ ID NO: 1314 - DNA, 10 bp, Artificial Sequence
  synthetic Reed-Solomon code for 8+2 base, 1 base error, 2 nocall correction
ctgacacccc

SEQ ID NO: 1315 - DNA, 10 bp, Artificial Sequence
  synthetic Reed-Solomon code for 8+2 base, 1 base error, 2 nocall correction
ggtacaccac

SEQ ID NO: 1316 - DNA, 10 bp, Artificial Sequence
  synthetic Reed-Solomon code for 8+2 base, 1 base error, 2 nocall correction
acaccaccgc

SEQ ID NO: 1317 - DNA, 10 bp, Artificial Sequence
  synthetic Reed-Solomon code for 8+2 base, 1 base error, 2 nocall correction
cgaccacctt

SEQ ID NO: 1318 - DNA, 10 bp, Artificial Sequence
  synthetic Reed-Solomon code for 8+2 base, 1 base error, 2 nocall correction
ataccaccta

SEQ ID NO: 1319 - DNA, 10 bp, Artificial Sequence
  synthetic Reed-Solomon code for 8+2 base, 1 base error, 2 nocall correction
cccccaccga

SEQ ID NO: 1320 - DNA, 10 bp, Artificial Sequence
  synthetic Reed-Solomon code for 8+2 base, 1 base error, 2 nocall correction
ctcccacctc

SEQ ID NO: 1321 - DNA, 10 bp, Artificial Sequence
  synthetic Reed-Solomon code for 8+2 base, 1 base error, 2 nocall correction
gtgccacctg

SEQ ID NO: 1322 - DNA, 10 bp, Artificial Sequence
  synthetic Reed-Solomon code for 8+2 base, 1 base error, 2 nocall correction
tttccacctt

SEQ ID NO: 1323 - DNA, 10 bp, Artificial Sequence
  synthetic Reed-Solomon code for 8+2 base, 1 base error, 2 nocall correction
cgggcaccca

SEQ ID NO: 1324 - DNA, 10 bp, Artificial Sequence
  synthetic Reed-Solomon code for 8+2 base, 1 base error, 2 nocall correction
atggcaccct

SEQ ID NO: 1325 - DNA, 10 bp, Artificial Sequence
  synthetic Reed-Solomon code for 8+2 base, 1 base error, 2 nocall correction
gttgcaccaa

SEQ ID NO: 1326 - DNA, 10 bp, Artificial Sequence
  synthetic Reed-Solomon code for 8+2 base, 1 base error, 2 nocall correction
gactcacctt

SEQ ID NO: 1327 - DNA, 10 bp, Artificial Sequence
  synthetic Reed-Solomon code for 8+2 base, 1 base error, 2 nocall correction
tcctcaccct

SEQ ID NO: 1328 - DNA, 10 bp, Artificial Sequence
  synthetic Reed-Solomon code for 8+2 base, 1 base error, 2 nocall correction
ccttcacccc

SEQ ID NO: 1329 - DNA, 10 bp, Artificial Sequence
  synthetic Reed-Solomon code for 8+2 base, 1 base error, 2 nocall correction
gcaagaccgt

SEQ ID NO: 1330 - DNA, 10 bp, Artificial Sequence
  synthetic Reed-Solomon code for 8+2 base, 1 base error, 2 nocall correction
ggcagaccta

SEQ ID NO: 1331 - DNA, 10 bp, Artificial Sequence
  synthetic Reed-Solomon code for 8+2 base, 1 base error, 2 nocall correction
agacgacccg

SEQ ID NO: 1332 - DNA, 10 bp, Artificial Sequence
  synthetic Reed-Solomon code for 8+2 base, 1 base error, 2 nocall correction
tgacgaccaa

SEQ ID NO: 1333 - DNA, 10 bp, Artificial Sequence
  synthetic Reed-Solomon code for 8+2 base, 1 base error, 2 nocall correction
gggcgaccca

SEQ ID NO: 1334 - DNA, 10 bp, Artificial Sequence
  synthetic Reed-Solomon code for 8+2 base, 1 base error, 2 nocall correction
agtcgaccat

SEQ ID NO: 1335 - DNA, 10 bp, Artificial Sequence
  synthetic Reed-Solomon code for 8+2 base, 1 base error, 2 nocall correction
cttcgaccaa

SEQ ID NO: 1336 - DNA, 10 bp, Artificial Sequence
  synthetic Reed-Solomon code for 8+2 base, 1 base error, 2 nocall correction
ggaggacctt

SEQ ID NO: 1337 - DNA, 10 bp, Artificial Sequence
  synthetic Reed-Solomon code for 8+2 base, 1 base error, 2 nocall correction
gccggaccga

SEQ ID NO: 1338 - DNA, 10 bp, Artificial Sequence
  synthetic Reed-Solomon code for 8+2 base, 1 base error, 2 nocall correction
gtcggacctc

SEQ ID NO: 1339 - DNA, 10 bp, Artificial Sequence
  synthetic Reed-Solomon code for 8+2 base, 1 base error, 2 nocall correction
ctgggacctg

SEQ ID NO: 1340 - DNA, 10 bp, Artificial Sequence
  synthetic Reed-Solomon code for 8+2 base, 1 base error, 2 nocall correction
ttatgaccgg

SEQ ID NO: 1341 - DNA, 10 bp, Artificial Sequence
  synthetic Reed-Solomon code for 8+2 base, 1 base error, 2 nocall correction
aagtgacccc

SEQ ID NO: 1342 - DNA, 10 bp, Artificial Sequence
  synthetic Reed-Solomon code for 8+2 base, 1 base error, 2 nocall correction
cgttgaccgg

SEQ ID NO: 1343 - DNA, 10 bp, Artificial Sequence
  synthetic Reed-Solomon code for 8+2 base, 1 base error, 2 nocall correction
caaataccat

SEQ ID NO: 1344 - DNA, 10 bp, Artificial Sequence
  synthetic Reed-Solomon code for 8+2 base, 1 base error, 2 nocall correction
ccgatacctt

SEQ ID NO: 1345 - DNA, 10 bp, Artificial Sequence
  synthetic Reed-Solomon code for 8+2 base, 1 base error, 2 nocall correction
aggataccgc

SEQ ID NO: 1346 - DNA, 10 bp, Artificial Sequence
  synthetic Reed-Solomon code for 8+2 base, 1 base error, 2 nocall correction
catatacccg

SEQ ID NO: 1347 - DNA, 10 bp, Artificial Sequence
  synthetic Reed-Solomon code for 8+2 base, 1 base error, 2 nocall correction
cccctaccct

SEQ ID NO: 1348 - DNA, 10 bp, Artificial Sequence
  synthetic Reed-Solomon code for 8+2 base, 1 base error, 2 nocall correction
gatctacctc

SEQ ID NO: 1349 - DNA, 10 bp, Artificial Sequence
  synthetic Reed-Solomon code for 8+2 base, 1 base error, 2 nocall correction
tctctacccc

SEQ ID NO: 1350 - DNA, 10 bp, Artificial Sequence
  synthetic Reed-Solomon code for 8+2 base, 1 base error, 2 nocall correction
aaagtaccac

SEQ ID NO: 1351 - DNA, 10 bp, Artificial Sequence
  synthetic Reed-Solomon code for 8+2 base, 1 base error, 2 nocall correction
gtagtaccgg

SEQ ID NO: 1352 - DNA, 10 bp, Artificial Sequence
  synthetic Reed-Solomon code for 8+2 base, 1 base error, 2 nocall correction
cacgtaccaa

SEQ ID NO: 1353 - DNA, 10 bp, Artificial Sequence
  synthetic Reed-Solomon code for 8+2 base, 1 base error, 2 nocall correction
acggtacctc

SEQ ID NO: 1354 - DNA, 10 bp, Artificial Sequence
  synthetic Reed-Solomon code for 8+2 base, 1 base error, 2 nocall correction
cgggtaccgt

SEQ ID NO: 1355 - DNA, 10 bp, Artificial Sequence
  synthetic Reed-Solomon code for 8+2 base, 1 base error, 2 nocall correction
atggtaccga

SEQ ID NO: 1356 - DNA, 10 bp, Artificial Sequence
  synthetic Reed-Solomon code for 8+2 base, 1 base error, 2 nocall correction
tgattacctt

SEQ ID NO: 1357 - DNA, 10 bp, Artificial Sequence
  synthetic Reed-Solomon code for 8+2 base, 1 base error, 2 nocall correction
tccttaccga

SEQ ID NO: 1358 - DNA, 10 bp, Artificial Sequence
  synthetic Reed-Solomon code for 8+2 base, 1 base error, 2 nocall correction
ttcttacctc

SEQ ID NO: 1359 - DNA, 10 bp, Artificial Sequence
  synthetic Reed-Solomon code for 8+2 base, 1 base error, 2 nocall correction
agtttaccta

SEQ ID NO: 1360 - DNA, 10 bp, Artificial Sequence
  synthetic Reed-Solomon code for 8+2 base, 1 base error, 2 nocall correction
cttttacctt

SEQ ID NO: 1361 - DNA, 10 bp, Artificial Sequence
  synthetic Reed-Solomon code for 8+2 base, 1 base error, 2 nocall correction
ttcaaccctg

SEQ ID NO: 1362 - DNA, 10 bp, Artificial Sequence
  synthetic Reed-Solomon code for 8+2 base, 1 base error, 2 nocall correction
aaacacccgc

SEQ ID NO: 1363 - DNA, 10 bp, Artificial Sequence
  synthetic Reed-Solomon code for 8+2 base, 1 base error, 2 nocall correction
gtacacccag

SEQ ID NO: 1364 - DNA, 10 bp, Artificial Sequence
  synthetic Reed-Solomon code for 8+2 base, 1 base error, 2 nocall correction
caccacccga

SEQ ID NO: 1365 - DNA, 10 bp, Artificial Sequence
  synthetic Reed-Solomon code for 8+2 base, 1 base error, 2 nocall correction
cggcacccat

SEQ ID NO: 1366 - DNA, 10 bp, Artificial Sequence
  synthetic Reed-Solomon code for 8+2 base, 1 base error, 2 nocall correction
atgcacccaa

SEQ ID NO: 1367 - DNA, 10 bp, Artificial Sequence
  synthetic Reed-Solomon code for 8+2 base, 1 base error, 2 nocall correction
ttgcaccccg

SEQ ID NO: 1368 - DNA, 10 bp, Artificial Sequence
  synthetic Reed-Solomon code for 8+2 base, 1 base error, 2 nocall correction
gttcacccct

SEQ ID NO: 1369 - DNA, 10 bp, Artificial Sequence
  synthetic Reed-Solomon code for 8+2 base, 1 base error, 2 nocall correction
attgaccctg

SEQ ID NO: 1370 - DNA, 10 bp, Artificial Sequence
  synthetic Reed-Solomon code for 8+2 base, 1 base error, 2 nocall correction
ggatacccga

SEQ ID NO: 1371 - DNA, 10 bp, Artificial Sequence
  synthetic Reed-Solomon code for 8+2 base, 1 base error, 2 nocall correction
tactacccct

SEQ ID NO: 1372 - DNA, 10 bp, Artificial Sequence
  synthetic Reed-Solomon code for 8+2 base, 1 base error, 2 nocall correction
gcctaccctt

SEQ ID NO: 1373 - DNA, 10 bp, Artificial Sequence
  synthetic Reed-Solomon code for 8+2 base, 1 base error, 2 nocall correction
aggtacccgg

SEQ ID NO: 1374 - DNA, 10 bp, Artificial Sequence
  synthetic Reed-Solomon code for 8+2 base, 1 base error, 2 nocall correction
cattaccccc

SEQ ID NO: 1375 - DNA, 10 bp, Artificial Sequence
  synthetic Reed-Solomon code for 8+2 base, 1 base error, 2 nocall correction
caaaccccgc

SEQ ID NO: 1376 - DNA, 10 bp, Artificial Sequence
  synthetic Reed-Solomon code for 8+2 base, 1 base error, 2 nocall correction
aacaccccga

SEQ ID NO: 1377 - DNA, 10 bp, Artificial Sequence
  synthetic Reed-Solomon code for 8+2 base, 1 base error, 2 nocall correction
aggaccccat

SEQ ID NO: 1378 - DNA, 10 bp, Artificial Sequence
  synthetic Reed-Solomon code for 8+2 base, 1 base error, 2 nocall correction
ctgaccccaa

SEQ ID NO: 1379 - DNA, 10 bp, Artificial Sequence
  synthetic Reed-Solomon code for 8+2 base, 1 base error, 2 nocall correction
ggtaccccca

SEQ ID NO: 1380 - DNA, 10 bp, Artificial Sequence
  synthetic Reed-Solomon code for 8+2 base, 1 base error, 2 nocall correction
tcacccccgg

SEQ ID NO: 1381 - DNA, 10 bp, Artificial Sequence
  synthetic Reed-Solomon code for 8+2 base, 1 base error, 2 nocall correction
aaagccccgt

SEQ ID NO: 1382 - DNA, 10 bp, Artificial Sequence
  synthetic Reed-Solomon code for 8+2 base, 1 base error, 2 nocall correction
ggcgccccag

SEQ ID NO: 1383 - DNA, 10 bp, Artificial Sequence
  synthetic Reed-Solomon code for 8+2 base, 1 base error, 2 nocall correction
cgggccccac

SEQ ID NO: 1384 - DNA, 10 bp, Artificial Sequence
  synthetic Reed-Solomon code for 8+2 base, 1 base error, 2 nocall correction
tatgccccga

SEQ ID NO: 1385 - DNA, 10 bp, Artificial Sequence
  synthetic Reed-Solomon code for 8+2 base, 1 base error, 2 nocall correction
gttgcccccc

SEQ ID NO: 1386 - DNA, 10 bp, Artificial Sequence
  synthetic Reed-Solomon code for 8+2 base, 1 base error, 2 nocall correction
ccttccccaa

SEQ ID NO: 1387 - DNA, 10 bp, Artificial Sequence
  synthetic Reed-Solomon code for 8+2 base, 1 base error, 2 nocall correction
ttgagccctt

SEQ ID NO: 1388 - DNA, 10 bp, Artificial Sequence
  synthetic Reed-Solomon code for 8+2 base, 1 base error, 2 nocall correction
gttagccctg

SEQ ID NO: 1389 - DNA, 10 bp, Artificial Sequence
  synthetic Reed-Solomon code for 8+2 base, 1 base error, 2 nocall correction
tgacgccccc

SEQ ID NO: 1390 - DNA, 10 bp, Artificial Sequence
  synthetic Reed-Solomon code for 8+2 base, 1 base error, 2 nocall correction
cgccgcccag

SEQ ID NO: 1391 - DNA, 10 bp, Artificial Sequence
  synthetic Reed-Solomon code for 8+2 base, 1 base error, 2 nocall correction
ttccgcccct

SEQ ID NO: 1392 - DNA, 10 bp, Artificial Sequence
  synthetic Reed-Solomon code for 8+2 base, 1 base error, 2 nocall correction
gggcgcccac

SEQ ID NO: 1393 - DNA, 10 bp, Artificial Sequence
  synthetic Reed-Solomon code for 8+2 base, 1 base error, 2 nocall correction
cttcgccccc

SEQ ID NO: 1394 - DNA, 10 bp, Artificial Sequence
  synthetic Reed-Solomon code for 8+2 base, 1 base error, 2 nocall correction
gaatgcccag

SEQ ID NO: 1395 - DNA, 10 bp, Artificial Sequence
  synthetic Reed-Solomon code for 8+2 base, 1 base error, 2 nocall correction
acatgcccta

SEQ ID NO: 1396 - DNA, 10 bp, Artificial Sequence
  synthetic Reed-Solomon code for 8+2 base, 1 base error, 2 nocall correction
atatgcccgc

SEQ ID NO: 1397 - DNA, 10 bp, Artificial Sequence
  synthetic Reed-Solomon code for 8+2 base, 1 base error, 2 nocall correction
ccctgccctc

SEQ ID NO: 1398 - DNA, 10 bp, Artificial Sequence
  synthetic Reed-Solomon code for 8+2 base, 1 base error, 2 nocall correction
agctgcccgt

SEQ ID NO: 1399 - DNA, 10 bp, Artificial Sequence
  synthetic Reed-Solomon code for 8+2 base, 1 base error, 2 nocall correction
ctctgcccga

SEQ ID NO: 1400 - DNA, 10 bp, Artificial Sequence
  synthetic Reed-Solomon code for 8+2 base, 1 base error, 2 nocall correction
aagtgcccaa

SEQ ID NO: 1401 - DNA, 10 bp, Artificial Sequence
  synthetic Reed-Solomon code for 8+2 base, 1 base error, 2 nocall correction
tagtgccccg

SEQ ID NO: 1402 - DNA, 10 bp, Artificial Sequence
  synthetic Reed-Solomon code for 8+2 base, 1 base error, 2 nocall correction
gcgtgccctg

SEQ ID NO: 1403 - DNA, 10 bp, Artificial Sequence
  synthetic Reed-Solomon code for 8+2 base, 1 base error, 2 nocall correction
gattgcccct

SEQ ID NO: 1404 - DNA, 10 bp, Artificial Sequence
  synthetic Reed-Solomon code for 8+2 base, 1 base error, 2 nocall correction
tcttgccctt

SEQ ID NO: 1405 - DNA, 10 bp, Artificial Sequence
  synthetic Reed-Solomon code for 8+2 base, 1 base error, 2 nocall correction
aacatcccct

SEQ ID NO: 1406 - DNA, 10 bp, Artificial Sequence
  synthetic Reed-Solomon code for 8+2 base, 1 base error, 2 nocall correction
tggatcccgg

SEQ ID NO: 1407 - DNA, 10 bp, Artificial Sequence
  synthetic Reed-Solomon code for 8+2 base, 1 base error, 2 nocall correction
ggtatcccgt

SEQ ID NO: 1408 - DNA, 10 bp, Artificial Sequence
  synthetic Reed-Solomon code for 8+2 base, 1 base error, 2 nocall correction
acactcccat

SEQ ID NO: 1409 - DNA, 10 bp, Artificial Sequence
  synthetic Reed-Solomon code for 8+2 base, 1 base error, 2 nocall correction
aagctccctt

SEQ ID NO: 1410 - DNA, 10 bp, Artificial Sequence
  synthetic Reed-Solomon code for 8+2 base, 1 base error, 2 nocall correction
actctccccg

SEQ ID NO: 1411 - DNA, 10 bp, Artificial Sequence
  synthetic Reed-Solomon code for 8+2 base, 1 base error, 2 nocall correction
tctctcccaa

SEQ ID NO: 1412 - DNA, 10 bp, Artificial Sequence
  synthetic Reed-Solomon code for 8+2 base, 1 base error, 2 nocall correction
aaagtcccca

SEQ ID NO: 1413 - DNA, 10 bp, Artificial Sequence
  synthetic Reed-Solomon code for 8+2 base, 1 base error, 2 nocall correction
taagtcccag

SEQ ID NO: 1414 - DNA, 10 bp, Artificial Sequence
  synthetic Reed-Solomon code for 8+2 base, 1 base error, 2 nocall correction
cacgtccccc

SEQ ID NO: 1415 - DNA, 10 bp, Artificial Sequence
  synthetic Reed-Solomon code for 8+2 base, 1 base error, 2 nocall correction
gaggtccccg

SEQ ID NO: 1416 - DNA, 10 bp, Artificial Sequence
  synthetic Reed-Solomon code for 8+2 base, 1 base error, 2 nocall correction
tcggtccctg

SEQ ID NO: 1417 - DNA, 10 bp, Artificial Sequence
  synthetic Reed-Solomon code for 8+2 base, 1 base error, 2 nocall correction
tatgtcccct

SEQ ID NO: 1418 - DNA, 10 bp, Artificial Sequence
  synthetic Reed-Solomon code for 8+2 base, 1 base error, 2 nocall correction
gctgtccctt

SEQ ID NO: 1419 - DNA, 10 bp, Artificial Sequence
  synthetic Reed-Solomon code for 8+2 base, 1 base error, 2 nocall correction
ccattcccgg

SEQ ID NO: 1420 - DNA, 10 bp, Artificial Sequence
  synthetic Reed-Solomon code for 8+2 base, 1 base error, 2 nocall correction
atcttccctg

SEQ ID NO: 1421 - DNA, 10 bp, Artificial Sequence
  synthetic Reed-Solomon code for 8+2 base, 1 base error, 2 nocall correction
gacaagccta

SEQ ID NO: 1422 - DNA, 10 bp, Artificial Sequence
  synthetic Reed-Solomon code for 8+2 base, 1 base error, 2 nocall correction
accaagccag

SEQ ID NO: 1423 - DNA, 10 bp, Artificial Sequence
  synthetic Reed-Solomon code for 8+2 base, 1 base error, 2 nocall correction
tccaagccca

SEQ ID NO: 1424 - DNA, 10 bp, Artificial Sequence
  synthetic Reed-Solomon code for 8+2 base, 1 base error, 2 nocall correction
aaacagcccg

SEQ ID NO: 1425 - DNA, 10 bp, Artificial Sequence
  synthetic Reed-Solomon code for 8+2 base, 1 base error, 2 nocall correction
taacagccaa

SEQ ID NO: 1426 - DNA, 10 bp, Artificial Sequence
  synthetic Reed-Solomon code for 8+2 base, 1 base error, 2 nocall correction
gagcagccca

SEQ ID NO: 1427 - DNA, 10 bp, Artificial Sequence
  synthetic Reed-Solomon code for 8+2 base, 1 base error, 2 nocall correction
tcgcagccta

SEQ ID NO: 1428 - DNA, 10 bp, Artificial Sequence
  synthetic Reed-Solomon code for 8+2 base, 1 base error, 2 nocall correction
ttgcagccgc

SEQ ID NO: 1429 - DNA, 10 bp, Artificial Sequence
  synthetic Reed-Solomon code for 8+2 base, 1 base error, 2 nocall correction
aatcagccat

SEQ ID NO: 1430 - DNA, 10 bp, Artificial Sequence
  synthetic Reed-Solomon code for 8+2 base, 1 base error, 2 nocall correction
gaagagcctt

SEQ ID NO: 1431 - DNA, 10 bp, Artificial Sequence
  synthetic Reed-Solomon code for 8+2 base, 1 base error, 2 nocall correction
tcagagccct

SEQ ID NO: 1432 - DNA, 10 bp, Artificial Sequence
  synthetic Reed-Solomon code for 8+2 base, 1 base error, 2 nocall correction
gcggagccat

SEQ ID NO: 1433 - DNA, 10 bp, Artificial Sequence
  synthetic Reed-Solomon code for 8+2 base, 1 base error, 2 nocall correction
actgagccca

SEQ ID NO: 1434 - DNA, 10 bp, Artificial Sequence
  synthetic Reed-Solomon code for 8+2 base, 1 base error, 2 nocall correction
tctgagccag

SEQ ID NO: 1435 - DNA, 10 bp, Artificial Sequence
  synthetic Reed-Solomon code for 8+2 base, 1 base error, 2 nocall correction
aggtagcccc

SEQ ID NO: 1436 - DNA, 10 bp, Artificial Sequence
  synthetic Reed-Solomon code for 8+2 base, 1 base error, 2 nocall correction
cattagccgg

SEQ ID NO: 1437 - DNA, 10 bp, Artificial Sequence
  synthetic Reed-Solomon code for 8+2 base, 1 base error, 2 nocall correction
caaacgcccg

SEQ ID NO: 1438 - DNA, 10 bp, Artificial Sequence
  synthetic Reed-Solomon code for 8+2 base, 1 base error, 2 nocall correction
tacacgccac

SEQ ID NO: 1439 - DNA, 10 bp, Artificial Sequence
  synthetic Reed-Solomon code for 8+2 base, 1 base error, 2 nocall correction
catacgccat

SEQ ID NO: 1440 - DNA, 10 bp, Artificial Sequence
  synthetic Reed-Solomon code for 8+2 base, 1 base error, 2 nocall correction
gaaccgcctc

SEQ ID NO: 1441 - DNA, 10 bp, Artificial Sequence
  synthetic Reed-Solomon code for 8+2 base, 1 base error, 2 nocall correction
tcaccgcccc

SEQ ID NO: 1442 - DNA, 10 bp, Artificial Sequence
  synthetic Reed-Solomon code for 8+2 base, 1 base error, 2 nocall correction
cccccgccag

SEQ ID NO: 1443 - DNA, 10 bp, Artificial Sequence
  synthetic Reed-Solomon code for 8+2 base, 1 base error, 2 nocall correction
gcgccgccac

SEQ ID NO: 1444 - DNA, 10 bp, Artificial Sequence
  synthetic Reed-Solomon code for 8+2 base, 1 base error, 2 nocall correction
ttggcgccgt

SEQ ID NO: 1445 - DNA, 10 bp, Artificial Sequence
  synthetic Reed-Solomon code for 8+2 base, 1 base error, 2 nocall correction
aatgcgccac

SEQ ID NO: 1446 - DNA, 10 bp, Artificial Sequence
  synthetic Reed-Solomon code for 8+2 base, 1 base error, 2 nocall correction
gttgcgccgg

SEQ ID NO: 1447 - DNA, 10 bp, Artificial Sequence
  synthetic Reed-Solomon code for 8+2 base, 1 base error, 2 nocall correction
agatcgccta

SEQ ID NO: 1448 - DNA, 10 bp, Artificial Sequence
  synthetic Reed-Solomon code for 8+2 base, 1 base error, 2 nocall correction
ctatcgcctt

SEQ ID NO: 1449 - DNA, 10 bp, Artificial Sequence
  synthetic Reed-Solomon code for 8+2 base, 1 base error, 2 nocall correction
acctcgccgt

SEQ ID NO: 1450 - DNA, 10 bp, Artificial Sequence
  synthetic Reed-Solomon code for 8+2 base, 1 base error, 2 nocall correction
cgctcgcctc

SEQ ID NO: 1451 - DNA, 10 bp, Artificial Sequence
  synthetic Reed-Solomon code for 8+2 base, 1 base error, 2 nocall correction
gggtcgcctg

SEQ ID NO: 1452 - DNA, 10 bp, Artificial Sequence
  synthetic Reed-Solomon code for 8+2 base, 1 base error, 2 nocall correction
tgttcgcctt

SEQ ID NO: 1453 - DNA, 10 bp, Artificial Sequence
  synthetic Reed-Solomon code for 8+2 base, 1 base error, 2 nocall correction
aaaaggcctt

SEQ ID NO: 1454 - DNA, 10 bp, Artificial Sequence
  synthetic Reed-Solomon code for 8+2 base, 1 base error, 2 nocall correction
acgaggccat

SEQ ID NO: 1455 - DNA, 10 bp, Artificial Sequence
  synthetic Reed-Solomon code for 8+2 base, 1 base error, 2 nocall correction
tataggccta

SEQ ID NO: 1456 - DNA, 10 bp, Artificial Sequence
  synthetic Reed-Solomon code for 8+2 base, 1 base error, 2 nocall correction
gctaggccca

SEQ ID NO: 1457 - DNA, 10 bp, Artificial Sequence
  synthetic Reed-Solomon code for 8+2 base, 1 base error, 2 nocall correction
tgacggccgg

SEQ ID NO: 1458 - DNA, 10 bp, Artificial Sequence
  synthetic Reed-Solomon code for 8+2 base, 1 base error, 2 nocall correction
cttcggccgg

SEQ ID NO: 1459 - DNA, 10 bp, Artificial Sequence
  synthetic Reed-Solomon code for 8+2 base, 1 base error, 2 nocall correction
caagggcctc

SEQ ID NO: 1460 - DNA, 10 bp, Artificial Sequence
  synthetic Reed-Solomon code for 8+2 base, 1 base error, 2 nocall correction
aacgggccta

SEQ ID NO: 1461 - DNA, 10 bp, Artificial Sequence
  synthetic Reed-Solomon code for 8+2 base, 1 base error, 2 nocall correction
gccgggccag

SEQ ID NO: 1462 - DNA, 10 bp, Artificial Sequence
  synthetic Reed-Solomon code for 8+2 base, 1 base error, 2 nocall correction
ccggggccac

SEQ ID NO: 1463 - DNA, 10 bp, Artificial Sequence
  synthetic Reed-Solomon code for 8+2 base, 1 base error, 2 nocall correction
atatggcccg

SEQ ID NO: 1464 - DNA, 10 bp, Artificial Sequence
  synthetic Reed-Solomon code for 8+2 base, 1 base error, 2 nocall correction
ttatggccaa

SEQ ID NO: 1465 - DNA, 10 bp, Artificial Sequence
  synthetic Reed-Solomon code for 8+2 base, 1 base error, 2 nocall correction
tagtggccgc

SEQ ID NO: 1466 - DNA, 10 bp, Artificial Sequence
  synthetic Reed-Solomon code for 8+2 base, 1 base error, 2 nocall correction
gtgtggccca

SEQ ID NO: 1467 - DNA, 10 bp, Artificial Sequence
  synthetic Reed-Solomon code for 8+2 base, 1 base error, 2 nocall correction
cgttggccaa

SEQ ID NO: 1468 - DNA, 10 bp, Artificial Sequence
  synthetic Reed-Solomon code for 8+2 base, 1 base error, 2 nocall correction
atttggccat

SEQ ID NO: 1469 - DNA, 10 bp, Artificial Sequence
  synthetic Reed-Solomon code for 8+2 base, 1 base error, 2 nocall correction
ggaatgccac

SEQ ID NO: 1470 - DNA, 10 bp, Artificial Sequence
  synthetic Reed-Solomon code for 8+2 base, 1 base error, 2 nocall correction
gtcatgccat

SEQ ID NO: 1471 - DNA, 10 bp, Artificial Sequence
  synthetic Reed-Solomon code for 8+2 base, 1 base error, 2 nocall correction
tggatgcccc

SEQ ID NO: 1472 - DNA, 10 bp, Artificial Sequence
  synthetic Reed-Solomon code for 8+2 base, 1 base error, 2 nocall correction
ttactgcctt

SEQ ID NO: 1473 - DNA, 10 bp, Artificial Sequence
  synthetic Reed-Solomon code for 8+2 base, 1 base error, 2 nocall correction
tgcctgcctc

SEQ ID NO: 1474 - DNA, 10 bp, Artificial Sequence
  synthetic Reed-Solomon code for 8+2 base, 1 base error, 2 nocall correction
actctgccgc

SEQ ID NO: 1475 - DNA, 10 bp, Artificial Sequence
  synthetic Reed-Solomon code for 8+2 base, 1 base error, 2 nocall correction
cgtctgcctt

SEQ ID NO: 1476 - DNA, 10 bp, Artificial Sequence
  synthetic Reed-Solomon code for 8+2 base, 1 base error, 2 nocall correction
attctgccta

SEQ ID NO: 1477 - DNA, 10 bp, Artificial Sequence
  synthetic Reed-Solomon code for 8+2 base, 1 base error, 2 nocall correction
gtagtgccaa

SEQ ID NO: 1478 - DNA, 10 bp, Artificial Sequence
  synthetic Reed-Solomon code for 8+2 base, 1 base error, 2 nocall correction
cacgtgccgg

SEQ ID NO: 1479 - DNA, 10 bp, Artificial Sequence
  synthetic Reed-Solomon code for 8+2 base, 1 base error, 2 nocall correction
gaggtgccgc

SEQ ID NO: 1480 - DNA, 10 bp, Artificial Sequence
  synthetic Reed-Solomon code for 8+2 base, 1 base error, 2 nocall correction
atggtgccag

SEQ ID NO: 1481 - DNA, 10 bp, Artificial Sequence
  synthetic Reed-Solomon code for 8+2 base, 1 base error, 2 nocall correction
ttggtgccca

SEQ ID NO: 1482 - DNA, 10 bp, Artificial Sequence
  synthetic Reed-Solomon code for 8+2 base, 1 base error, 2 nocall correction
ccattgcccc

SEQ ID NO: 1483 - DNA, 10 bp, Artificial Sequence
  synthetic Reed-Solomon code for 8+2 base, 1 base error, 2 nocall correction
accttgccca

SEQ ID NO: 1484 - DNA, 10 bp, Artificial Sequence
  synthetic Reed-Solomon code for 8+2 base, 1 base error, 2 nocall correction
tccttgccag

SEQ ID NO: 1485 - DNA, 10 bp, Artificial Sequence
  synthetic Reed-Solomon code for 8+2 base, 1 base error, 2 nocall correction
agaaatccaa

SEQ ID NO: 1486 - DNA, 10 bp, Artificial Sequence
  synthetic Reed-Solomon code for 8+2 base, 1 base error, 2 nocall correction
tgaaatcccg

SEQ ID NO: 1487 - DNA, 10 bp, Artificial Sequence
  synthetic Reed-Solomon code for 8+2 base, 1 base error, 2 nocall correction
ctaaatccat

SEQ ID NO: 1488 - DNA, 10 bp, Artificial Sequence
  synthetic Reed-Solomon code for 8+2 base, 1 base error, 2 nocall correction
cgcaatccac

SEQ ID NO: 1489 - DNA, 10 bp, Artificial Sequence
  synthetic Reed-Solomon code for 8+2 base, 1 base error, 2 nocall correction
gggaatccag

SEQ ID NO: 1490 - DNA, 10 bp, Artificial Sequence
  synthetic Reed-Solomon code for 8+2 base, 1 base error, 2 nocall correction
tgtaatccat

SEQ ID NO: 1491 - DNA, 10 bp, Artificial Sequence
  synthetic Reed-Solomon code for 8+2 base, 1 base error, 2 nocall correction
cttaatcccg

SEQ ID NO: 1492 - DNA, 10 bp, Artificial Sequence
  synthetic Reed-Solomon code for 8+2 base, 1 base error, 2 nocall correction
gctcatccga

SEQ ID NO: 1493 - DNA, 10 bp, Artificial Sequence
  synthetic Reed-Solomon code for 8+2 base, 1 base error, 2 nocall correction
gttcatcctc

SEQ ID NO: 1494 - DNA, 10 bp, Artificial Sequence
  synthetic Reed-Solomon code for 8+2 base, 1 base error, 2 nocall correction
gaagatccgg

SEQ ID NO: 1495 - DNA, 10 bp, Artificial Sequence
  synthetic Reed-Solomon code for 8+2 base, 1 base error, 2 nocall correction
atagatccac

SEQ ID NO: 1496 - DNA, 10 bp, Artificial Sequence
  synthetic Reed-Solomon code for 8+2 base, 1 base error, 2 nocall correction
agcgatccat

SEQ ID NO: 1497 - DNA, 10 bp, Artificial Sequence
  synthetic Reed-Solomon code for 8+2 base, 1 base error, 2 nocall correction
ctcgatccaa

SEQ ID NO: 1498 - DNA, 10 bp, Artificial Sequence
  synthetic Reed-Solomon code for 8+2 base, 1 base error, 2 nocall correction
aaggatccga

SEQ ID NO: 1499 - DNA, 10 bp, Artificial Sequence
  synthetic Reed-Solomon code for 8+2 base, 1 base error, 2 nocall correction
tactatcctc

SEQ ID NO: 1500 - DNA, 10 bp, Artificial Sequence
  synthetic Reed-Solomon code for 8+2 base, 1 base error, 2 nocall correction
gcctatcccc

SEQ ID NO: 1501 - DNA, 10 bp, Artificial Sequence
  synthetic Reed-Solomon code for 8+2 base, 1 base error, 2 nocall correction
ccgtatcccg

SEQ ID NO: 1502 - DNA, 10 bp, Artificial Sequence
  synthetic Reed-Solomon code for 8+2 base, 1 base error, 2 nocall correction
cattatcctt

SEQ ID NO: 1503 - DNA, 10 bp, Artificial Sequence
  synthetic Reed-Solomon code for 8+2 base, 1 base error, 2 nocall correction
cgacctccaa

SEQ ID NO: 1504 - DNA, 10 bp, Artificial Sequence
  synthetic Reed-Solomon code for 8+2 base, 1 base error, 2 nocall correction
atacctccat

SEQ ID NO: 1505 - DNA, 10 bp, Artificial Sequence
  synthetic Reed-Solomon code for 8+2 base, 1 base error, 2 nocall correction
agccctccac

SEQ ID NO: 1506 - DNA, 10 bp, Artificial Sequence
  synthetic Reed-Solomon code for 8+2 base, 1 base error, 2 nocall correction
attcctcccg

SEQ ID NO: 1507 - DNA, 10 bp, Artificial Sequence
  synthetic Reed-Solomon code for 8+2 base, 1 base error, 2 nocall correction
tttcctccaa

SEQ ID NO: 1508 - DNA, 10 bp, Artificial Sequence
  synthetic Reed-Solomon code for 8+2 base, 1 base error, 2 nocall correction
ttggctcctg

SEQ ID NO: 1509 - DNA, 10 bp, Artificial Sequence
  synthetic Reed-Solomon code for 8+2 base, 1 base error, 2 nocall correction
gttgctcctt

SEQ ID NO: 1510 - DNA, 10 bp, Artificial Sequence
  synthetic Reed-Solomon code for 8+2 base, 1 base error, 2 nocall correction
ctatctccgg

SEQ ID NO: 1511 - DNA, 10 bp, Artificial Sequence
  synthetic Reed-Solomon code for 8+2 base, 1 base error, 2 nocall correction
gactctccaa

SEQ ID NO: 1512 - DNA, 10 bp, Artificial Sequence
  synthetic Reed-Solomon code for 8+2 base, 1 base error, 2 nocall correction
acctctcctg

SEQ ID NO: 1513 - DNA, 10 bp, Artificial Sequence
  synthetic Reed-Solomon code for 8+2 base, 1 base error, 2 nocall correction
gggtctccgt

SEQ ID NO: 1514 - DNA, 10 bp, Artificial Sequence
  synthetic Reed-Solomon code for 8+2 base, 1 base error, 2 nocall correction
tgttctccgg

SEQ ID NO: 1515 - DNA, 10 bp, Artificial Sequence
  synthetic Reed-Solomon code for 8+2 base, 1 base error, 2 nocall correction
aaaagtccgg

SEQ ID NO: 1516 - DNA, 10 bp, Artificial Sequence
  synthetic Reed-Solomon code for 8+2 base, 1 base error, 2 nocall correction
gtaagtccac

SEQ ID NO: 1517 - DNA, 10 bp, Artificial Sequence
  synthetic Reed-Solomon code for 8+2 base, 1 base error, 2 nocall correction
ggcagtccat

SEQ ID NO: 1518 - DNA, 10 bp, Artificial Sequence
  synthetic Reed-Solomon code for 8+2 base, 1 base error, 2 nocall correction
gagagtccga

SEQ ID NO: 1519 - DNA, 10 bp, Artificial Sequence
  synthetic Reed-Solomon code for 8+2 base, 1 base error, 2 nocall correction
ttgagtcccc

SEQ ID NO: 1520 - DNA, 10 bp, Artificial Sequence
  synthetic Reed-Solomon code for 8+2 base, 1 base error, 2 nocall correction
tgacgtcctt

SEQ ID NO: 1521 - DNA, 10 bp, Artificial Sequence
  synthetic Reed-Solomon code for 8+2 base, 1 base error, 2 nocall correction
tcccgtccga

SEQ ID NO: 1522 - DNA, 10 bp, Artificial Sequence
  synthetic Reed-Solomon code for 8+2 base, 1 base error, 2 nocall correction
ttccgtcctc

SEQ ID NO: 1523 - DNA, 10 bp, Artificial Sequence
  synthetic Reed-Solomon code for 8+2 base, 1 base error, 2 nocall correction
agtcgtccta

SEQ ID NO: 1524 - DNA, 10 bp, Artificial Sequence
  synthetic Reed-Solomon code for 8+2 base, 1 base error, 2 nocall correction
cttcgtcctt

SEQ ID NO: 1525 - DNA, 10 bp, Artificial Sequence
  synthetic Reed-Solomon code for 8+2 base, 1 base error, 2 nocall correction
ggaggtccaa

SEQ ID NO: 1526 - DNA, 10 bp, Artificial Sequence
  synthetic Reed-Solomon code for 8+2 base, 1 base error, 2 nocall correction
aggggtccag

SEQ ID NO: 1527 - DNA, 10 bp, Artificial Sequence
  synthetic Reed-Solomon code for 8+2 base, 1 base error, 2 nocall correction
tggggtccca

SEQ ID NO: 1528 - DNA, 10 bp, Artificial Sequence
  synthetic Reed-Solomon code for 8+2 base, 1 base error, 2 nocall correction
ccctgtccct

SEQ ID NO: 1529 - DNA, 10 bp, Artificial Sequence
  synthetic Reed-Solomon code for 8+2 base, 1 base error, 2 nocall correction
gattgtcctc

SEQ ID NO: 1530 - DNA, 10 bp, Artificial Sequence
  synthetic Reed-Solomon code for 8+2 base, 1 base error, 2 nocall correction
tcttgtcccc

SEQ ID NO: 1531 - DNA, 10 bp, Artificial Sequence
  synthetic Reed-Solomon code for 8+2 base, 1 base error, 2 nocall correction
caaattccta

SEQ ID NO: 1532 - DNA, 10 bp, Artificial Sequence
  synthetic Reed-Solomon code for 8+2 base, 1 base error, 2 nocall correction
aacattcctc

SEQ ID NO: 1533 - DNA, 10 bp, Artificial Sequence
  synthetic Reed-Solomon code for 8+2 base, 1 base error, 2 nocall correction
ccgattccaa

SEQ ID NO: 1534 - DNA, 10 bp, Artificial Sequence
  synthetic Reed-Solomon code for 8+2 base, 1 base error, 2 nocall correction
ttacttccgg

SEQ ID NO: 1535 - DNA, 10 bp, Artificial Sequence
  synthetic Reed-Solomon code for 8+2 base, 1 base error, 2 nocall correction
aagcttcccc

SEQ ID NO: 1536 - DNA, 10 bp, Artificial Sequence
  synthetic Reed-Solomon code for 8+2 base, 1 base error, 2 nocall correction
cgtcttccgg

SEQ ID NO: 1537 - DNA, 10 bp, Artificial Sequence
  synthetic Reed-Solomon code for 8+2 base, 1 base error, 2 nocall correction
cacgttcctt

SEQ ID NO: 1538 - DNA, 10 bp, Artificial Sequence
  synthetic Reed-Solomon code for 8+2 base, 1 base error, 2 nocall correction
tatgttcctc

SEQ ID NO: 1539 - DNA, 10 bp, Artificial Sequence
  synthetic Reed-Solomon code for 8+2 base, 1 base error, 2 nocall correction
gctgttcccc

SEQ ID NO: 1540 - DNA, 10 bp, Artificial Sequence
  synthetic Reed-Solomon code for 8+2 base, 1 base error, 2 nocall correction
agatttcccg

SEQ ID NO: 1541 - DNA, 10 bp, Artificial Sequence
  synthetic Reed-Solomon code for 8+2 base, 1 base error, 2 nocall correction
tgatttccaa

SEQ ID NO: 1542 - DNA, 10 bp, Artificial Sequence
  synthetic Reed-Solomon code for 8+2 base, 1 base error, 2 nocall correction
gggtttccca

SEQ ID NO: 1543 - DNA, 10 bp, Artificial Sequence
  synthetic Reed-Solomon code for 8+2 base, 1 base error, 2 nocall correction
agttttccat

SEQ ID NO: 1544 - DNA, 10 bp, Artificial Sequence
  synthetic Reed-Solomon code for 8+2 base, 1 base error, 2 nocall correction
ctttttccaa

SEQ ID NO: 1545 - DNA, 10 bp, Artificial Sequence
  synthetic Reed-Solomon code for 8+2 base, 1 base error, 2 nocall correction
taaaaagctc

SEQ ID NO: 1546 - DNA, 10 bp, Artificial Sequence
  synthetic Reed-Solomon code for 8+2 base, 1 base error, 2 nocall correction
gcaaaagccc

SEQ ID NO: 1547 - DNA, 10 bp, Artificial Sequence
  synthetic Reed-Solomon code for 8+2 base, 1 base error, 2 nocall correction
tcgaaagcac

SEQ ID NO: 1548 - DNA, 10 bp, Artificial Sequence
  synthetic Reed-Solomon code for 8+2 base, 1 base error, 2 nocall correction
ccacaagctg

SEQ ID NO: 1549 - DNA, 10 bp, Artificial Sequence
  synthetic Reed-Solomon code for 8+2 base, 1 base error, 2 nocall correction
gaccaagcac

SEQ ID NO: 1550 - DNA, 10 bp, Artificial Sequence
  synthetic Reed-Solomon code for 8+2 base, 1 base error, 2 nocall correction
atccaagcgg

SEQ ID NO: 1551 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
cagcaagcag

SEQ ID NO: 1552 - DNA, 10 bp, Artificial Sequence
  synthetic Reed-Solomon code for 8+2 base, 1 base error, 2 nocall correction
catgaagcta

SEQ ID NO: 1553 - DNA, 10 bp, Artificial Sequence
  synthetic Reed-Solomon code for 8+2 base, 1 base error, 2 nocall correction
cgataagcac

SEQ ID NO: 1554 - DNA, 10 bp, Artificial Sequence
  synthetic Reed-Solomon code for 8+2 base, 1 base error, 2 nocall correction
agctaagcaa

SEQ ID NO: 1555 - DNA, 10 bp, Artificial Sequence
  synthetic Reed-Solomon code for 8+2 base, 1 base error, 2 nocall correction
tgctaagccg

SEQ ID NO: 1556 - DNA, 10 bp, Artificial Sequence
  synthetic Reed-Solomon code for 8+2 base, 1 base error, 2 nocall correction
ctctaagcat

SEQ ID NO: 1557 - DNA, 10 bp, Artificial Sequence
  synthetic Reed-Solomon code for 8+2 base, 1 base error, 2 nocall correction
aagtaagcgt

SEQ ID NO: 1558 - DNA, 10 bp, Artificial Sequence
  synthetic Reed-Solomon code for 8+2 base, 1 base error, 2 nocall correction
ttttaagcac

SEQ ID NO: 1559 - DNA, 10 bp, Artificial Sequence
  synthetic Reed-Solomon code for 8+2 base, 1 base error, 2 nocall correction
gaaacagcaa

SEQ ID NO: 1560 - DNA, 10 bp, Artificial Sequence
  synthetic Reed-Solomon code for 8+2 base, 1 base error, 2 nocall correction
acaacagctg

SEQ ID NO: 1561 - DNA, 10 bp, Artificial Sequence
  synthetic Reed-Solomon code for 8+2 base, 1 base error, 2 nocall correction
ctcacagcgg

SEQ ID NO: 1562 - DNA, 10 bp, Artificial Sequence
  synthetic Reed-Solomon code for 8+2 base, 1 base error, 2 nocall correction
aagacagcag

SEQ ID NO: 1563 - DNA, 10 bp, Artificial Sequence
  synthetic Reed-Solomon code for 8+2 base, 1 base error, 2 nocall correction
tagacagcca

SEQ ID NO: 1564 - DNA, 10 bp, Artificial Sequence
  synthetic Reed-Solomon code for 8+2 base, 1 base error, 2 nocall correction
gcgacagcta

SEQ ID NO: 1565 - DNA, 10 bp, Artificial Sequence
  synthetic Reed-Solomon code for 8+2 base, 1 base error, 2 nocall correction
gtgacagcgc

SEQ ID NO: 1566 - DNA, 10 bp, Artificial Sequence
  synthetic Reed-Solomon code for 8+2 base, 1 base error, 2 nocall correction
tacccagcta

SEQ ID NO: 1567 - DNA, 10 bp, Artificial Sequence
  synthetic Reed-Solomon code for 8+2 base, 1 base error, 2 nocall correction
gccccagcca

SEQ ID NO: 1568 - DNA, 10 bp, Artificial Sequence
  synthetic Reed-Solomon code for 8+2 base, 1 base error, 2 nocall correction
agagcagcgg

SEQ ID NO: 1569 - DNA, 10 bp, Artificial Sequence
  synthetic Reed-Solomon code for 8+2 base, 1 base error, 2 nocall correction
gacgcagcat

SEQ ID NO: 1570 - DNA, 10 bp, Artificial Sequence
  synthetic Reed-Solomon code for 8+2 base, 1 base error, 2 nocall correction
ggggcagcga

SEQ ID NO: 1571 - DNA, 10 bp, Artificial Sequence
  synthetic Reed-Solomon code for 8+2 base, 1 base error, 2 nocall correction
gcttcagcgc

SEQ ID NO: 1572 - DNA, 10 bp, Artificial Sequence
  synthetic Reed-Solomon code for 8+2 base, 1 base error, 2 nocall correction
gtttcagcta

SEQ ID NO: 1573 - DNA, 10 bp, Artificial Sequence
  synthetic Reed-Solomon code for 8+2 base, 1 base error, 2 nocall correction
ccaagagcct

SEQ ID NO: 1574 - DNA, 10 bp, Artificial Sequence
  synthetic Reed-Solomon code for 8+2 base, 1 base error, 2 nocall correction
cctagagcag

SEQ ID NO: 1575 - DNA, 10 bp, Artificial Sequence
  synthetic Reed-Solomon code for 8+2 base, 1 base error, 2 nocall correction
caccgagcat

SEQ ID NO: 1576 - DNA, 10 bp, Artificial Sequence
  synthetic Reed-Solomon code for 8+2 base, 1 base error, 2 nocall correction
cggcgagcga

SEQ ID NO: 1577 - DNA, 10 bp, Artificial Sequence
  synthetic Reed-Solomon code for 8+2 base, 1 base error, 2 nocall correction
atgcgagcgt

SEQ ID NO: 1578 - DNA, 10 bp, Artificial Sequence
  synthetic Reed-Solomon code for 8+2 base, 1 base error, 2 nocall correction
tatcgagcac

SEQ ID NO: 1579 - DNA, 10 bp, Artificial Sequence
  synthetic Reed-Solomon code for 8+2 base, 1 base error, 2 nocall correction
acaggagccc

SEQ ID NO: 1580 - DNA, 10 bp, Artificial Sequence
  synthetic Reed-Solomon code for 8+2 base, 1 base error, 2 nocall correction
cccggagcca

SEQ ID NO: 1581 - DNA, 10 bp, Artificial Sequence
  synthetic Reed-Solomon code for 8+2 base, 1 base error, 2 nocall correction
ggatgagcat

SEQ ID NO: 1582 - DNA, 10 bp, Artificial Sequence
  synthetic Reed-Solomon code for 8+2 base, 1 base error, 2 nocall correction
aactgagcgg

SEQ ID NO: 1583 - DNA, 10 bp, Artificial Sequence
  synthetic Reed-Solomon code for 8+2 base, 1 base error, 2 nocall correction
gtctgagcac

SEQ ID NO: 1584 - DNA, 10 bp, Artificial Sequence
  synthetic Reed-Solomon code for 8+2 base, 1 base error, 2 nocall correction
tggtgagcct

SEQ ID NO: 1585 - DNA, 10 bp, Artificial Sequence
  synthetic Reed-Solomon code for 8+2 base, 1 base error, 2 nocall correction
ctgtgagcag

SEQ ID NO: 1586 - DNA, 10 bp, Artificial Sequence
  synthetic Reed-Solomon code for 8+2 base, 1 base error, 2 nocall correction
ggttgagccg

SEQ ID NO: 1587 - DNA, 10 bp, Artificial Sequence
  synthetic Reed-Solomon code for 8+2 base, 1 base error, 2 nocall correction
agcatagccg

SEQ ID NO: 1588 - DNA, 10 bp, Artificial Sequence
  synthetic Reed-Solomon code for 8+2 base, 1 base error, 2 nocall correction
tgcatagcaa

SEQ ID NO: 1589 - DNA, 10 bp, Artificial Sequence
  synthetic Reed-Solomon code for 8+2 base, 1 base error, 2 nocall correction
tagatagcgt

SEQ ID NO: 1590 - DNA, 10 bp, Artificial Sequence
  synthetic Reed-Solomon code for 8+2 base, 1 base error, 2 nocall correction
gatatagcgg

SEQ ID NO: 1591 - DNA, 10 bp, Artificial Sequence
  synthetic Reed-Solomon code for 8+2 base, 1 base error, 2 nocall correction
attatagcac

SEQ ID NO: 1592 - DNA, 10 bp, Artificial Sequence
  synthetic Reed-Solomon code for 8+2 base, 1 base error, 2 nocall correction
ggactagcta

SEQ ID NO: 1593 - DNA, 10 bp, Artificial Sequence
  synthetic Reed-Solomon code for 8+2 base, 1 base error, 2 nocall correction
gccctagcgt

SEQ ID NO: 1594 - DNA, 10 bp, Artificial Sequence
  synthetic Reed-Solomon code for 8+2 base, 1 base error, 2 nocall correction
aggctagctg

SEQ ID NO: 1595 - DNA, 10 bp, Artificial Sequence
  synthetic Reed-Solomon code for 8+2 base, 1 base error, 2 nocall correction
tgagtagcat

SEQ ID NO: 1596 - DNA, 10 bp, Artificial Sequence
  synthetic Reed-Solomon code for 8+2 base, 1 base error, 2 nocall correction
ctagtagccg

SEQ ID NO: 1597 - DNA, 10 bp, Artificial Sequence
  synthetic Reed-Solomon code for 8+2 base, 1 base error, 2 nocall correction
ttcgtagcac

SEQ ID NO: 1598 - DNA, 10 bp, Artificial Sequence
  synthetic Reed-Solomon code for 8+2 base, 1 base error, 2 nocall correction
ggggtagcct

SEQ ID NO: 1599 - DNA, 10 bp, Artificial Sequence
  synthetic Reed-Solomon code for 8+2 base, 1 base error, 2 nocall correction
agtgtagcaa

SEQ ID NO: 1600 - DNA, 10 bp, Artificial Sequence
  synthetic Reed-Solomon code for 8+2 base, 1 base error, 2 nocall correction
tgtgtagccg

SEQ ID NO: 1601 - DNA, 10 bp, Artificial Sequence
  synthetic Reed-Solomon code for 8+2 base, 1 base error, 2 nocall correction
cttgtagcat

SEQ ID NO: 1602 - DNA, 10 bp, Artificial Sequence
  synthetic Reed-Solomon code for 8+2 base, 1 base error, 2 nocall correction
aaattagctc

SEQ ID NO: 1603 - DNA, 10 bp, Artificial Sequence
  synthetic Reed-Solomon code for 8+2 base, 1 base error, 2 nocall correction
cacttagcta

SEQ ID NO: 1604 - DNA, 10 bp, Artificial Sequence
  synthetic Reed-Solomon code for 8+2 base, 1 base error, 2 nocall correction
acgttagcac

SEQ ID NO: 1605 - DNA, 10 bp, Artificial Sequence
  synthetic Reed-Solomon code for 8+2 base, 1 base error, 2 nocall correction
aaaaacgctg

SEQ ID NO: 1606 - DNA, 10 bp, Artificial Sequence
  synthetic Reed-Solomon code for 8+2 base, 1 base error, 2 nocall correction
gcaaacgcaa

SEQ ID NO: 1607 - DNA, 10 bp, Artificial Sequence
  synthetic Reed-Solomon code for 8+2 base, 1 base error, 2 nocall correction
gagaacgcta

SEQ ID NO: 1608 - DNA, 10 bp, Artificial Sequence
  synthetic Reed-Solomon code for 8+2 base, 1 base error, 2 nocall correction
acgaacgcag

SEQ ID NO: 1609 - DNA, 10 bp, Artificial Sequence
  synthetic Reed-Solomon code for 8+2 base, 1 base error, 2 nocall correction
tcgaacgcca

SEQ ID NO: 1610 - DNA, 10 bp, Artificial Sequence
  synthetic Reed-Solomon code for 8+2 base, 1 base error, 2 nocall correction
tgacacgcgt

SEQ ID NO: 1611 - DNA, 10 bp, Artificial Sequence
  synthetic Reed-Solomon code for 8+2 base, 1 base error, 2 nocall correction
gaccacgcca

SEQ ID NO: 1612 - DNA, 10 bp, Artificial Sequence
  synthetic Reed-Solomon code for 8+2 base, 1 base error, 2 nocall correction
tcccacgcta

SEQ ID NO: 1613 - DNA, 10 bp, Artificial Sequence
  synthetic Reed-Solomon code for 8+2 base, 1 base error, 2 nocall correction
ttccacgcgc

SEQ ID NO: 1614 - DNA, 10 bp, Artificial Sequence
  synthetic Reed-Solomon code for 8+2 base, 1 base error, 2 nocall correction
agtcacgcga

SEQ ID NO: 1615 - DNA, 10 bp, Artificial Sequence
  synthetic Reed-Solomon code for 8+2 base, 1 base error, 2 nocall correction
cttcacgcgt

SEQ ID NO: 1616 - DNA, 10 bp, Artificial Sequence
  synthetic Reed-Solomon code for 8+2 base, 1 base error, 2 nocall correction
gccgacgcat

SEQ ID NO: 1617 - DNA, 10 bp, Artificial Sequence
  synthetic Reed-Solomon code for 8+2 base, 1 base error, 2 nocall correction
cgatacgcca

SEQ ID NO: 1618 - DNA, 10 bp, Artificial Sequence
  synthetic Reed-Solomon code for 8+2 base, 1 base error, 2 nocall correction
atatacgcct

SEQ ID NO: 1619 - DNA, 10 bp, Artificial Sequence
  synthetic Reed-Solomon code for 8+2 base, 1 base error, 2 nocall correction
agctacgccc

SEQ ID NO: 1620 - DNA, 10 bp, Artificial Sequence
  synthetic Reed-Solomon code for 8+2 base, 1 base error, 2 nocall correction
gattacgcgc

SEQ ID NO: 1621 - DNA, 10 bp, Artificial Sequence
  synthetic Reed-Solomon code for 8+2 base, 1 base error, 2 nocall correction
atttacgcag

SEQ ID NO: 1622 - DNA, 10 bp, Artificial Sequence
  synthetic Reed-Solomon code for 8+2 base, 1 base error, 2 nocall correction
ttttacgcca

SEQ ID NO: 1623 - DNA, 10 bp, Artificial Sequence
  synthetic Reed-Solomon code for 8+2 base, 1 base error, 2 nocall correction
gaaaccgccc

SEQ ID NO: 1624 - DNA, 10 bp, Artificial Sequence
  synthetic Reed-Solomon code for 8+2 base, 1 base error, 2 nocall correction
tcaaccgctc

SEQ ID NO: 1625 - DNA, 10 bp, Artificial Sequence
  synthetic Reed-Solomon code for 8+2 base, 1 base error, 2 nocall correction
ttaaccgcga

SEQ ID NO: 1626 - DNA, 10 bp, Artificial Sequence
  synthetic Reed-Solomon code for 8+2 base, 1 base error, 2 nocall correction
tagaccgcac

SEQ ID NO: 1627 - DNA, 10 bp, Artificial Sequence
  synthetic Reed-Solomon code for 8+2 base, 1 base error, 2 nocall correction
cgtaccgcga

SEQ ID NO: 1628 - DNA, 10 bp, Artificial Sequence
  synthetic Reed-Solomon code for 8+2 base, 1 base error, 2 nocall correction
attaccgcgt

SEQ ID NO: 1629 - DNA, 10 bp, Artificial Sequence
  synthetic Reed-Solomon code for 8+2 base, 1 base error, 2 nocall correction
caacccgctg

SEQ ID NO: 1630 - DNA, 10 bp, Artificial Sequence
  synthetic Reed-Solomon code for 8+2 base, 1 base error, 2 nocall correction
gcccccgcac

SEQ ID NO: 1631 - DNA, 10 bp, Artificial Sequence
  synthetic Reed-Solomon code for 8+2 base, 1 base error, 2 nocall correction
ccgcccgcag

SEQ ID NO: 1632 - DNA, 10 bp, Artificial Sequence
  synthetic Reed-Solomon code for 8+2 base, 1 base error, 2 nocall correction
tgagccgcgc

SEQ ID NO: 1633 - DNA, 10 bp, Artificial Sequence
  synthetic Reed-Solomon code for 8+2 base, 1 base error, 2 nocall correction
ttcgccgcgt

SEQ ID NO: 1634 - DNA, 10 bp, Artificial Sequence
  synthetic Reed-Solomon code for 8+2 base, 1 base error, 2 nocall correction
cctgccgcta

SEQ ID NO: 1635 - DNA, 10 bp, Artificial Sequence
  synthetic Reed-Solomon code for 8+2 base, 1 base error, 2 nocall correction
cttgccgcgc

SEQ ID NO: 1636 - DNA, 10 bp, Artificial Sequence
  synthetic Reed-Solomon code for 8+2 base, 1 base error, 2 nocall correction
ggctccgctg

SEQ ID NO: 1637 - DNA, 10 bp, Artificial Sequence
  synthetic Reed-Solomon code for 8+2 base, 1 base error, 2 nocall correction
acgtccgcgt

SEQ ID NO: 1638 - DNA, 10 bp, Artificial Sequence
  synthetic Reed-Solomon code for 8+2 base, 1 base error, 2 nocall correction
cggtccgctc

SEQ ID NO: 1639 - DNA, 10 bp, Artificial Sequence
  synthetic Reed-Solomon code for 8+2 base, 1 base error, 2 nocall correction
accagcgcat

SEQ ID NO: 1640 - DNA, 10 bp, Artificial Sequence
  synthetic Reed-Solomon code for 8+2 base, 1 base error, 2 nocall correction
aaacgcgcct

SEQ ID NO: 1641 - DNA, 10 bp, Artificial Sequence
  synthetic Reed-Solomon code for 8+2 base, 1 base error, 2 nocall correction
aatcgcgcag

SEQ ID NO: 1642 - DNA, 10 bp, Artificial Sequence
  synthetic Reed-Solomon code for 8+2 base, 1 base error, 2 nocall correction
tatcgcgcca

SEQ ID NO: 1643 - DNA, 10 bp, Artificial Sequence
  synthetic Reed-Solomon code for 8+2 base, 1 base error, 2 nocall correction
gctcgcgcta

SEQ ID NO: 1644 - DNA, 10 bp, Artificial Sequence
  synthetic Reed-Solomon code for 8+2 base, 1 base error, 2 nocall correction
gttcgcgcgc

SEQ ID NO: 1645 - DNA, 10 bp, Artificial Sequence
  synthetic Reed-Solomon code for 8+2 base, 1 base error, 2 nocall correction
gaaggcgctg

SEQ ID NO: 1646 - DNA, 10 bp, Artificial Sequence
  synthetic Reed-Solomon code for 8+2 base, 1 base error, 2 nocall correction
acaggcgcaa

SEQ ID NO: 1647 - DNA, 10 bp, Artificial Sequence
  synthetic Reed-Solomon code for 8+2 base, 1 base error, 2 nocall correction
tcaggcgccg

SEQ ID NO: 1648 - DNA, 10 bp, Artificial Sequence
  synthetic Reed-Solomon code for 8+2 base, 1 base error, 2 nocall correction
cccggcgcac

SEQ ID NO: 1649 - DNA, 10 bp, Artificial Sequence
  synthetic Reed-Solomon code for 8+2 base, 1 base error, 2 nocall correction
aagggcgcta

SEQ ID NO: 1650 - DNA, 10 bp, Artificial Sequence
  synthetic Reed-Solomon code for 8+2 base, 1 base error, 2 nocall correction
gcgggcgcag

SEQ ID NO: 1651 - DNA, 10 bp, Artificial Sequence
  synthetic Reed-Solomon code for 8+2 base, 1 base error, 2 nocall correction
tctggcgcat

SEQ ID NO: 1652 - DNA, 10 bp, Artificial Sequence
  synthetic Reed-Solomon code for 8+2 base, 1 base error, 2 nocall correction
tactgcgcgc

SEQ ID NO: 1653 - DNA, 10 bp, Artificial Sequence
  synthetic Reed-Solomon code for 8+2 base, 1 base error, 2 nocall correction
gtctgcgcca

SEQ ID NO: 1654 - DNA, 10 bp, Artificial Sequence
  synthetic Reed-Solomon code for 8+2 base, 1 base error, 2 nocall correction
cattgcgcgt

SEQ ID NO: 1655 - DNA, 10 bp, Artificial Sequence
  synthetic Reed-Solomon code for 8+2 base, 1 base error, 2 nocall correction
cgaatcgcag

SEQ ID NO: 1656 - DNA, 10 bp, Artificial Sequence
  synthetic Reed-Solomon code for 8+2 base, 1 base error, 2 nocall correction
ttaatcgcct

SEQ ID NO: 1657 - DNA, 10 bp, Artificial Sequence
  synthetic Reed-Solomon code for 8+2 base, 1 base error, 2 nocall correction
tgcatcgccc

SEQ ID NO: 1658 - DNA, 10 bp, Artificial Sequence
  synthetic Reed-Solomon code for 8+2 base, 1 base error, 2 nocall correction
gtgatcgcat

SEQ ID NO: 1659 - DNA, 10 bp, Artificial Sequence
  synthetic Reed-Solomon code for 8+2 base, 1 base error, 2 nocall correction
cgtatcgcct

SEQ ID NO: 1660 - DNA, 10 bp, Artificial Sequence
  synthetic Reed-Solomon code for 8+2 base, 1 base error, 2 nocall correction
attatcgcca

SEQ ID NO: 1661 - DNA, 10 bp, Artificial Sequence
  synthetic Reed-Solomon code for 8+2 base, 1 base error, 2 nocall correction
tttatcgcag

SEQ ID NO: 1662 - DNA, 10 bp, Artificial Sequence
  synthetic Reed-Solomon code for 8+2 base, 1 base error, 2 nocall correction
tggctcgctc

SEQ ID NO: 1663 - DNA, 10 bp, Artificial Sequence
  synthetic Reed-Solomon code for 8+2 base, 1 base error, 2 nocall correction
gacgtcgcgc

SEQ ID NO: 1664 - DNA, 10 bp, Artificial Sequence
  synthetic Reed-Solomon code for 8+2 base, 1 base error, 2 nocall correction
atcgtcgcag

SEQ ID NO: 1665 - DNA, 10 bp, Artificial Sequence
  synthetic Reed-Solomon code for 8+2 base, 1 base error, 2 nocall correction
ttcgtcgcca

SEQ ID NO: 1666 - DNA, 10 bp, Artificial Sequence
  synthetic Reed-Solomon code for 8+2 base, 1 base error, 2 nocall correction
caggtcgcgg

SEQ ID NO: 1667 - DNA, 10 bp, Artificial Sequence
  synthetic Reed-Solomon code for 8+2 base, 1 base error, 2 nocall correction
agtgtcgccc

SEQ ID NO: 1668 - DNA, 10 bp, Artificial Sequence
  synthetic Reed-Solomon code for 8+2 base, 1 base error, 2 nocall correction
taattcgctg

SEQ ID NO: 1669 - DNA, 10 bp, Artificial Sequence
  synthetic Reed-Solomon code for 8+2 base, 1 base error, 2 nocall correction
gcattcgccg

SEQ ID NO: 1670 - DNA, 10 bp, Artificial Sequence
  synthetic Reed-Solomon code for 8+2 base, 1 base error, 2 nocall correction
acgttcgcca

SEQ ID NO: 1671 - DNA, 10 bp, Artificial Sequence
  synthetic Reed-Solomon code for 8+2 base, 1 base error, 2 nocall correction
tcgttcgcag

SEQ ID NO: 1672 - DNA, 10 bp, Artificial Sequence
  synthetic Reed-Solomon code for 8+2 base, 1 base error, 2 nocall correction
gctttcgcat

SEQ ID NO: 1673 - DNA, 10 bp, Artificial Sequence
  synthetic Reed-Solomon code for 8+2 base, 1 base error, 2 nocall correction
ttgaaggctg

SEQ ID NO: 1674 - DNA, 10 bp, Artificial Sequence
  synthetic Reed-Solomon code for 8+2 base, 1 base error, 2 nocall correction
gttaaggctt

SEQ ID NO: 1675 - DNA, 10 bp, Artificial Sequence
  synthetic Reed-Solomon code for 8+2 base, 1 base error, 2 nocall correction
ctacaggcac

SEQ ID NO: 1676 - DNA, 10 bp, Artificial Sequence
  synthetic Reed-Solomon code for 8+2 base, 1 base error, 2 nocall correction
cgccaggcat

SEQ ID NO: 1677 - DNA, 10 bp, Artificial Sequence
  synthetic Reed-Solomon code for 8+2 base, 1 base error, 2 nocall correction
atccaggcaa

SEQ ID NO: 1678 - DNA, 10 bp, Artificial Sequence
  synthetic Reed-Solomon code for 8+2 base, 1 base error, 2 nocall correction
ttccaggccg

SEQ ID NO: 1679 - DNA, 10 bp, Artificial Sequence
  synthetic Reed-Solomon code for 8+2 base, 1 base error, 2 nocall correction
cagcaggcga

SEQ ID NO: 1680 - DNA, 10 bp, Artificial Sequence
  synthetic Reed-Solomon code for 8+2 base, 1 base error, 2 nocall correction
tgtcaggcac

SEQ ID NO: 1681 - DNA, 10 bp, Artificial Sequence
  synthetic Reed-Solomon code for 8+2 base, 1 base error, 2 nocall correction
gaataggcat

SEQ ID NO: 1682 - DNA, 10 bp, Artificial Sequence
  synthetic Reed-Solomon code for 8+2 base, 1 base error, 2 nocall correction
agctaggcgg

SEQ ID NO: 1683 - DNA, 10 bp, Artificial Sequence
  synthetic Reed-Solomon code for 8+2 base, 1 base error, 2 nocall correction
tagtaggcct

SEQ ID NO: 1684 - DNA, 10 bp, Artificial Sequence
  synthetic Reed-Solomon code for 8+2 base, 1 base error, 2 nocall correction
gcgtaggctt

SEQ ID NO: 1685 - DNA, 10 bp, Artificial Sequence
  synthetic Reed-Solomon code for 8+2 base, 1 base error, 2 nocall correction
gattaggccg

SEQ ID NO: 1686 - DNA, 10 bp, Artificial Sequence
  synthetic Reed-Solomon code for 8+2 base, 1 base error, 2 nocall correction
tcttaggctg

SEQ ID NO: 1687 - DNA, 10 bp, Artificial Sequence
  synthetic Reed-Solomon code for 8+2 base, 1 base error, 2 nocall correction
gaaacggcgg

SEQ ID NO: 1688 - DNA, 10 bp, Artificial Sequence
  synthetic Reed-Solomon code for 8+2 base, 1 base error, 2 nocall correction
ataacggcac

SEQ ID NO: 1689 - DNA, 10 bp, Artificial Sequence
  synthetic Reed-Solomon code for 8+2 base, 1 base error, 2 nocall correction
agcacggcat

SEQ ID NO: 1690 - DNA, 10 bp, Artificial Sequence
  synthetic Reed-Solomon code for 8+2 base, 1 base error, 2 nocall correction
ctcacggcaa

SEQ ID NO: 1691 - DNA, 10 bp, Artificial Sequence
  synthetic Reed-Solomon code for 8+2 base, 1 base error, 2 nocall correction
aagacggcga

SEQ ID NO: 1692 - DNA, 10 bp, Artificial Sequence
  synthetic Reed-Solomon code for 8+2 base, 1 base error, 2 nocall correction
ggtccggcta

SEQ ID NO: 1693 - DNA, 10 bp, Artificial Sequence
  synthetic Reed-Solomon code for 8+2 base, 1 base error, 2 nocall correction
agagcggcaa

SEQ ID NO: 1694 - DNA, 10 bp, Artificial Sequence
  synthetic Reed-Solomon code for 8+2 base, 1 base error, 2 nocall correction
tgagcggccg

SEQ ID NO: 1695 - DNA, 10 bp, Artificial Sequence
  synthetic Reed-Solomon code for 8+2 base, 1 base error, 2 nocall correction
ctagcggcat

SEQ ID NO: 1696 - DNA, 10 bp, Artificial Sequence
  synthetic Reed-Solomon code for 8+2 base, 1 base error, 2 nocall correction
cgcgcggcac

SEQ ID NO: 1697 - DNA, 10 bp, Artificial Sequence
  synthetic Reed-Solomon code for 8+2 base, 1 base error, 2 nocall correction
ggggcggcag

SEQ ID NO: 1698 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
tgtgcggcat

SEQ ID NO: 1699 - DNA, 10 bp, Artificial Sequence
  synthetic Reed-Solomon code for 8+2 base, 1 base error, 2 nocall correction
cttgcggccg

SEQ ID NO: 1700 - DNA, 10 bp, Artificial Sequence
  synthetic Reed-Solomon code for 8+2 base, 1 base error, 2 nocall correction
aattcggctc

SEQ ID NO: 1701 - DNA, 10 bp, Artificial Sequence
  synthetic Reed-Solomon code for 8+2 base, 1 base error, 2 nocall correction
tgaagggctc

SEQ ID NO: 1702 - DNA, 10 bp, Artificial Sequence
  synthetic Reed-Solomon code for 8+2 base, 1 base error, 2 nocall correction
ttcagggctt

SEQ ID NO: 1703 - DNA, 10 bp, Artificial Sequence
  synthetic Reed-Solomon code for 8+2 base, 1 base error, 2 nocall correction
cctagggcga

SEQ ID NO: 1704 - DNA, 10 bp, Artificial Sequence
  synthetic Reed-Solomon code for 8+2 base, 1 base error, 2 nocall correction
cttagggctc

SEQ ID NO: 1705 - DNA, 10 bp, Artificial Sequence
  synthetic Reed-Solomon code for 8+2 base, 1 base error, 2 nocall correction
gtacgggcat

SEQ ID NO: 1706 - DNA, 10 bp, Artificial Sequence
  synthetic Reed-Solomon code for 8+2 base, 1 base error, 2 nocall correction
ggccgggcac

SEQ ID NO: 1707 - DNA, 10 bp, Artificial Sequence
  synthetic Reed-Solomon code for 8+2 base, 1 base error, 2 nocall correction
cggcgggcag

SEQ ID NO: 1708 - DNA, 10 bp, Artificial Sequence
  synthetic Reed-Solomon code for 8+2 base, 1 base error, 2 nocall correction
ttgcgggcct

SEQ ID NO: 1709 - DNA, 10 bp, Artificial Sequence
  synthetic Reed-Solomon code for 8+2 base, 1 base error, 2 nocall correction
gttcgggccg

SEQ ID NO: 1710 - DNA, 10 bp, Artificial Sequence
  synthetic Reed-Solomon code for 8+2 base, 1 base error, 2 nocall correction
tcaggggcgc

SEQ ID NO: 1711 - DNA, 10 bp, Artificial Sequence
  synthetic Reed-Solomon code for 8+2 base, 1 base error, 2 nocall correction
ttaggggcta

SEQ ID NO: 1712 - DNA, 10 bp, Artificial Sequence
  synthetic Reed-Solomon code for 8+2 base, 1 base error, 2 nocall correction
cgtggggcta

SEQ ID NO: 1713 - DNA, 10 bp, Artificial Sequence
  synthetic Reed-Solomon code for 8+2 base, 1 base error, 2 nocall correction
attggggctt

SEQ ID NO: 1714 - DNA, 10 bp, Artificial Sequence
  synthetic Reed-Solomon code for 8+2 base, 1 base error, 2 nocall correction
caatgggcac

SEQ ID NO: 1715 - DNA, 10 bp, Artificial Sequence
  synthetic Reed-Solomon code for 8+2 base, 1 base error, 2 nocall correction
aactgggcaa

SEQ ID NO: 1716 - DNA, 10 bp, Artificial Sequence
  synthetic Reed-Solomon code for 8+2 base, 1 base error, 2 nocall correction
tactgggccg

SEQ ID NO: 1717 - DNA, 10 bp, Artificial Sequence
  synthetic Reed-Solomon code for 8+2 base, 1 base error, 2 nocall correction
gcctgggctg

SEQ ID NO: 1718 - DNA, 10 bp, Artificial Sequence
  synthetic Reed-Solomon code for 8+2 base, 1 base error, 2 nocall correction
ccgtgggctc

SEQ ID NO: 1719 - DNA, 10 bp, Artificial Sequence
  synthetic Reed-Solomon code for 8+2 base, 1 base error, 2 nocall correction
aggtgggcgt

SEQ ID NO: 1720 - DNA, 10 bp, Artificial Sequence
  synthetic Reed-Solomon code for 8+2 base, 1 base error, 2 nocall correction
ctgtgggcga

SEQ ID NO: 1721 - DNA, 10 bp, Artificial Sequence
  synthetic Reed-Solomon code for 8+2 base, 1 base error, 2 nocall correction
tgcatggcgg

SEQ ID NO: 1722 - DNA, 10 bp, Artificial Sequence
  synthetic Reed-Solomon code for 8+2 base, 1 base error, 2 nocall correction
aagatggcct

SEQ ID NO: 1723 - DNA, 10 bp, Artificial Sequence
  synthetic Reed-Solomon code for 8+2 base, 1 base error, 2 nocall correction
gatatggcaa

SEQ ID NO: 1724 - DNA, 10 bp, Artificial Sequence
  synthetic Reed-Solomon code for 8+2 base, 1 base error, 2 nocall correction
actatggctg

SEQ ID NO: 1725 - DNA, 10 bp, Artificial Sequence
  synthetic Reed-Solomon code for 8+2 base, 1 base error, 2 nocall correction
aacctggctt

SEQ ID NO: 1726 - DNA, 10 bp, Artificial Sequence
  synthetic Reed-Solomon code for 8+2 base, 1 base error, 2 nocall correction
gacgtggccg

SEQ ID NO: 1727 - DNA, 10 bp, Artificial Sequence
  synthetic Reed-Solomon code for 8+2 base, 1 base error, 2 nocall correction
tccgtggctg

SEQ ID NO: 1728 - DNA, 10 bp, Artificial Sequence
  synthetic Reed-Solomon code for 8+2 base, 1 base error, 2 nocall correction
caggtggccc

SEQ ID NO: 1729 - DNA, 10 bp, Artificial Sequence
  synthetic Reed-Solomon code for 8+2 base, 1 base error, 2 nocall correction
agtgtggcgg

SEQ ID NO: 1730 - DNA, 10 bp, Artificial Sequence
  synthetic Reed-Solomon code for 8+2 base, 1 base error, 2 nocall correction
gcattggcgc

SEQ ID NO: 1731 - DNA, 10 bp, Artificial Sequence
  synthetic Reed-Solomon code for 8+2 base, 1 base error, 2 nocall correction
gtattggcta

SEQ ID NO: 1732 - DNA, 10 bp, Artificial Sequence
  synthetic Reed-Solomon code for 8+2 base, 1 base error, 2 nocall correction
atgttggctg

SEQ ID NO: 1733 - DNA, 10 bp, Artificial Sequence
  synthetic Reed-Solomon code for 8+2 base, 1 base error, 2 nocall correction
ttgaatgcgt

SEQ ID NO: 1734 - DNA, 10 bp, Artificial Sequence
  synthetic Reed-Solomon code for 8+2 base, 1 base error, 2 nocall correction
aataatgcac

SEQ ID NO: 1735 - DNA, 10 bp, Artificial Sequence
  synthetic Reed-Solomon code for 8+2 base, 1 base error, 2 nocall correction
gttaatgcgg

SEQ ID NO: 1736 - DNA, 10 bp, Artificial Sequence
  synthetic Reed-Solomon code for 8+2 base, 1 base error, 2 nocall correction
cctcatgcca

SEQ ID NO: 1737 - DNA, 10 bp, Artificial Sequence
  synthetic Reed-Solomon code for 8+2 base, 1 base error, 2 nocall correction
caagatgccg

SEQ ID NO: 1738 - DNA, 10 bp, Artificial Sequence
  synthetic Reed-Solomon code for 8+2 base, 1 base error, 2 nocall correction
tacgatgcac

SEQ ID NO: 1739 - DNA, 10 bp, Artificial Sequence
  synthetic Reed-Solomon code for 8+2 base, 1 base error, 2 nocall correction
catgatgcat

SEQ ID NO: 1740 - DNA, 10 bp, Artificial Sequence
  synthetic Reed-Solomon code for 8+2 base, 1 base error, 2 nocall correction
acatatgcga

SEQ ID NO: 1741 - DNA, 10 bp, Artificial Sequence
  synthetic Reed-Solomon code for 8+2 base, 1 base error, 2 nocall correction
atatatgctc

SEQ ID NO: 1742 - DNA, 10 bp, Artificial Sequence
  synthetic Reed-Solomon code for 8+2 base, 1 base error, 2 nocall correction
ccctatgcgc

SEQ ID NO: 1743 - DNA, 10 bp, Artificial Sequence
  synthetic Reed-Solomon code for 8+2 base, 1 base error, 2 nocall correction
agctatgctt

SEQ ID NO: 1744 - DNA, 10 bp, Artificial Sequence
  synthetic Reed-Solomon code for 8+2 base, 1 base error, 2 nocall correction
ctctatgcta

SEQ ID NO: 1745 - DNA, 10 bp, Artificial Sequence
  synthetic Reed-Solomon code for 8+2 base, 1 base error, 2 nocall correction
gcgtatgcgg

SEQ ID NO: 1746 - DNA, 10 bp, Artificial Sequence
  synthetic Reed-Solomon code for 8+2 base, 1 base error, 2 nocall correction
tcttatgcgt

SEQ ID NO: 1747 - DNA, 10 bp, Artificial Sequence
  synthetic Reed-Solomon code for 8+2 base, 1 base error, 2 nocall correction
gaaactgctt

SEQ ID NO: 1748 - DNA, 10 bp, Artificial Sequence
  synthetic Reed-Solomon code for 8+2 base, 1 base error, 2 nocall correction
tcaactgcct

SEQ ID NO: 1749 - DNA, 10 bp, Artificial Sequence
  synthetic Reed-Solomon code for 8+2 base, 1 base error, 2 nocall correction
gcgactgcat

SEQ ID NO: 1750 - DNA, 10 bp, Artificial Sequence
  synthetic Reed-Solomon code for 8+2 base, 1 base error, 2 nocall correction
actactgcca

SEQ ID NO: 1751 - DNA, 10 bp, Artificial Sequence
  synthetic Reed-Solomon code for 8+2 base, 1 base error, 2 nocall correction
tctactgcag

SEQ ID NO: 1752 - DNA, 10 bp, Artificial Sequence
  synthetic Reed-Solomon code for 8+2 base, 1 base error, 2 nocall correction
taccctgcat

SEQ ID NO: 1753 - DNA, 10 bp, Artificial Sequence
  synthetic Reed-Solomon code for 8+2 base, 1 base error, 2 nocall correction
tggcctgcga

SEQ ID NO: 1754 - DNA, 10 bp, Artificial Sequence
  synthetic Reed-Solomon code for 8+2 base, 1 base error, 2 nocall correction
catcctgcac

SEQ ID NO: 1755 - DNA, 10 bp, Artificial Sequence
  synthetic Reed-Solomon code for 8+2 base, 1 base error, 2 nocall correction
gacgctgcta

SEQ ID NO: 1756 - DNA, 10 bp, Artificial Sequence
  synthetic Reed-Solomon code for 8+2 base, 1 base error, 2 nocall correction
accgctgcag

SEQ ID NO: 1757 - DNA, 10 bp, Artificial Sequence
  synthetic Reed-Solomon code for 8+2 base, 1 base error, 2 nocall correction
tccgctgcca

SEQ ID NO: 1758 - DNA, 10 bp, Artificial Sequence
  synthetic Reed-Solomon code for 8+2 base, 1 base error, 2 nocall correction
gtatctgccg

SEQ ID NO: 1759 - DNA, 10 bp, Artificial Sequence
  synthetic Reed-Solomon code for 8+2 base, 1 base error, 2 nocall correction
cggtctgcct

SEQ ID NO: 1760 - DNA, 10 bp, Artificial Sequence
  synthetic Reed-Solomon code for 8+2 base, 1 base error, 2 nocall correction
atgtctgcca

SEQ ID NO: 1761 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
ttgtctgcag

SEQ ID NO: 1762 - DNA, 10 bp, Artificial Sequence
  synthetic Reed-Solomon code for 8+2 base, 1 base error, 2 nocall correction
gtttctgcat

SEQ ID NO: 1763 - DNA, 10 bp, Artificial Sequence
  synthetic Reed-Solomon code for 8+2 base, 1 base error, 2 nocall correction
ttcagtgcgg

SEQ ID NO: 1764 - DNA, 10 bp, Artificial Sequence
  synthetic Reed-Solomon code for 8+2 base, 1 base error, 2 nocall correction
cagagtgcca

SEQ ID NO: 1765 - DNA, 10 bp, Artificial Sequence
  synthetic Reed-Solomon code for 8+2 base, 1 base error, 2 nocall correction
aaacgtgctc

SEQ ID NO: 1766 - DNA, 10 bp, Artificial Sequence
  synthetic Reed-Solomon code for 8+2 base, 1 base error, 2 nocall correction
caccgtgcta

SEQ ID NO: 1767 - DNA, 10 bp, Artificial Sequence
  synthetic Reed-Solomon code for 8+2 base, 1 base error, 2 nocall correction
acgcgtgcac

SEQ ID NO: 1768 - DNA, 10 bp, Artificial Sequence
  synthetic Reed-Solomon code for 8+2 base, 1 base error, 2 nocall correction
gatggtgcac

SEQ ID NO: 1769 - DNA, 10 bp, Artificial Sequence
  synthetic Reed-Solomon code for 8+2 base, 1 base error, 2 nocall correction
attggtgcgg

SEQ ID NO: 1770 - DNA, 10 bp, Artificial Sequence
  synthetic Reed-Solomon code for 8+2 base, 1 base error, 2 nocall correction
ggatgtgcta

SEQ ID NO: 1771 - DNA, 10 bp, Artificial Sequence
  synthetic Reed-Solomon code for 8+2 base, 1 base error, 2 nocall correction
gcctgtgcgt

SEQ ID NO: 1772 - DNA, 10 bp, Artificial Sequence
  synthetic Reed-Solomon code for 8+2 base, 1 base error, 2 nocall correction
aggtgtgctg

SEQ ID NO: 1773 - DNA, 10 bp, Artificial Sequence
  synthetic Reed-Solomon code for 8+2 base, 1 base error, 2 nocall correction
tcaattgcga

SEQ ID NO: 1774 - DNA, 10 bp, Artificial Sequence
  synthetic Reed-Solomon code for 8+2 base, 1 base error, 2 nocall correction
ttaattgctc

SEQ ID NO: 1775 - DNA, 10 bp, Artificial Sequence
  synthetic Reed-Solomon code for 8+2 base, 1 base error, 2 nocall correction
tgcattgctt

SEQ ID NO: 1776 - DNA, 10 bp, Artificial Sequence
  synthetic Reed-Solomon code for 8+2 base, 1 base error, 2 nocall correction
actattgcgt

SEQ ID NO: 1777 - DNA, 10 bp, Artificial Sequence
  synthetic Reed-Solomon code for 8+2 base, 1 base error, 2 nocall correction
cgtattgctc

SEQ ID NO: 1778 - DNA, 10 bp, Artificial Sequence
  synthetic Reed-Solomon code for 8+2 base, 1 base error, 2 nocall correction
ggacttgcat

SEQ ID NO: 1779 - DNA, 10 bp, Artificial Sequence
  synthetic Reed-Solomon code for 8+2 base, 1 base error, 2 nocall correction
aaccttgcgg

SEQ ID NO: 1780 - DNA, 10 bp, Artificial Sequence
  synthetic Reed-Solomon code for 8+2 base, 1 base error, 2 nocall correction
gtccttgcac

SEQ ID NO: 1781 - DNA, 10 bp, Artificial Sequence
  synthetic Reed-Solomon code for 8+2 base, 1 base error, 2 nocall correction
tggcttgcct

SEQ ID NO: 1782 - DNA, 10 bp, Artificial Sequence
  synthetic Reed-Solomon code for 8+2 base, 1 base error, 2 nocall correction
ctgcttgcag

SEQ ID NO: 1783 - DNA, 10 bp, Artificial Sequence
  synthetic Reed-Solomon code for 8+2 base, 1 base error, 2 nocall correction
ggtcttgccg

SEQ ID NO: 1784 - DNA, 10 bp, Artificial Sequence
  synthetic Reed-Solomon code for 8+2 base, 1 base error, 2 nocall correction
tgagttgcta

SEQ ID NO: 1785 - DNA, 10 bp, Artificial Sequence
  synthetic Reed-Solomon code for 8+2 base, 1 base error, 2 nocall correction
tccgttgcgt

SEQ ID NO: 1786 - DNA, 10 bp, Artificial Sequence
  synthetic Reed-Solomon code for 8+2 base, 1 base error, 2 nocall correction
cctgttgcgc

SEQ ID NO: 1787 - DNA, 10 bp, Artificial Sequence
  synthetic Reed-Solomon code for 8+2 base, 1 base error, 2 nocall correction
agtgttgctt

SEQ ID NO: 1788 - DNA, 10 bp, Artificial Sequence
  synthetic Reed-Solomon code for 8+2 base, 1 base error, 2 nocall correction
cttgttgcta

SEQ ID NO: 1789 - DNA, 10 bp, Artificial Sequence
  synthetic Reed-Solomon code for 8+2 base, 1 base error, 2 nocall correction
cactttgcat

SEQ ID NO: 1790 - DNA, 10 bp, Artificial Sequence
  synthetic Reed-Solomon code for 8+2 base, 1 base error, 2 nocall correction
cggtttgcga

SEQ ID NO: 1791 - DNA, 10 bp, Artificial Sequence
  synthetic Reed-Solomon code for 8+2 base, 1 base error, 2 nocall correction
atgtttgcgt

SEQ ID NO: 1792 - DNA, 10 bp, Artificial Sequence
  synthetic Reed-Solomon code for 8+2 base, 1 base error, 2 nocall correction
tattttgcac

SEQ ID NO: 1793 - DNA, 10 bp, Artificial Sequence
  synthetic Reed-Solomon code for 8+2 base, 1 base error, 2 nocall correction
gaaaaatcgc

SEQ ID NO: 1794 - DNA, 10 bp, Artificial Sequence
  synthetic Reed-Solomon code for 8+2 base, 1 base error, 2 nocall correction
ataaaatcag

SEQ ID NO: 1795 - DNA, 10 bp, Artificial Sequence
  synthetic Reed-Solomon code for 8+2 base, 1 base error, 2 nocall correction
ttaaaatcca

SEQ ID NO: 1796 - DNA, 10 bp, Artificial Sequence
  synthetic Reed-Solomon code for 8+2 base, 1 base error, 2 nocall correction
gtgaaatcaa

SEQ ID NO: 1797 - DNA, 10 bp, Artificial Sequence
  synthetic Reed-Solomon code for 8+2 base, 1 base error, 2 nocall correction
cgtaaatcca

SEQ ID NO: 1798 - DNA, 10 bp, Artificial Sequence
  synthetic Reed-Solomon code for 8+2 base, 1 base error, 2 nocall correction
attaaatcct

SEQ ID NO: 1799 - DNA, 10 bp, Artificial Sequence
  synthetic Reed-Solomon code for 8+2 base, 1 base error, 2 nocall correction
tgagaatccc

SEQ ID NO: 1800 - DNA, 10 bp, Artificial Sequence
  synthetic Reed-Solomon code for 8+2 base, 1 base error, 2 nocall correction
cgcgaatcag

SEQ ID NO: 1801 - DNA, 10 bp, Artificial Sequence
  synthetic Reed-Solomon code for 8+2 base, 1 base error, 2 nocall correction
ttcgaatcct

SEQ ID NO: 1802 - DNA, 10 bp, Artificial Sequence
  synthetic Reed-Solomon code for 8+2 base, 1 base error, 2 nocall correction
ggggaatcac

SEQ ID NO: 1803 - DNA, 10 bp, Artificial Sequence
  synthetic Reed-Solomon code for 8+2 base, 1 base error, 2 nocall correction
cttgaatccc

SEQ ID NO: 1804 - DNA, 10 bp, Artificial Sequence
  synthetic Reed-Solomon code for 8+2 base, 1 base error, 2 nocall correction
acgtaatcct

SEQ ID NO: 1805 - DNA, 10 bp, Artificial Sequence
  synthetic Reed-Solomon code for 8+2 base, 1 base error, 2 nocall correction
aattaatctg

SEQ ID NO: 1806 - DNA, 10 bp, Artificial Sequence
  synthetic Reed-Solomon code for 8+2 base, 1 base error, 2 nocall correction
gcttaatcaa

SEQ ID NO: 1807 - DNA, 10 bp, Artificial Sequence
  synthetic Reed-Solomon code for 8+2 base, 1 base error, 2 nocall correction
tcgacatcga

SEQ ID NO: 1808 - DNA, 10 bp, Artificial Sequence
  synthetic Reed-Solomon code for 8+2 base, 1 base error, 2 nocall correction
ttgacatctc

SEQ ID NO: 1809 - DNA, 10 bp, Artificial Sequence
  synthetic Reed-Solomon code for 8+2 base, 1 base error, 2 nocall correction
tgaccatcct

SEQ ID NO: 1810 - DNA, 10 bp, Artificial Sequence
  synthetic Reed-Solomon code for 8+2 base, 1 base error, 2 nocall correction
ctaccatcag

SEQ ID NO: 1811 - DNA, 10 bp, Artificial Sequence
  synthetic Reed-Solomon code for 8+2 base, 1 base error, 2 nocall correction
gacccatcga

SEQ ID NO: 1812 - DNA, 10 bp, Artificial Sequence
  synthetic Reed-Solomon code for 8+2 base, 1 base error, 2 nocall correction
ttcccatccc

SEQ ID NO: 1813 - DNA, 10 bp, Artificial Sequence
  synthetic Reed-Solomon code for 8+2 base, 1 base error, 2 nocall correction
gggccatcat

SEQ ID NO: 1814 - DNA, 10 bp, Artificial Sequence
  synthetic Reed-Solomon code for 8+2 base, 1 base error, 2 nocall correction
agtccatcca

SEQ ID NO: 1815 - DNA, 10 bp, Artificial Sequence
  synthetic Reed-Solomon code for 8+2 base, 1 base error, 2 nocall correction
tgtccatcag

SEQ ID NO: 1816 - DNA, 10 bp, Artificial Sequence
  synthetic Reed-Solomon code for 8+2 base, 1 base error, 2 nocall correction
cttccatcct

SEQ ID NO: 1817 - DNA, 10 bp, Artificial Sequence
  synthetic Reed-Solomon code for 8+2 base, 1 base error, 2 nocall correction
tgggcatcta

SEQ ID NO: 1818 - DNA, 10 bp, Artificial Sequence
  synthetic Reed-Solomon code for 8+2 base, 1 base error, 2 nocall correction
cgatcatcga

SEQ ID NO: 1819 - DNA, 10 bp, Artificial Sequence
  synthetic Reed-Solomon code for 8+2 base, 1 base error, 2 nocall correction
atatcatcgt

SEQ ID NO: 1820 - DNA, 10 bp, Artificial Sequence
  synthetic Reed-Solomon code for 8+2 base, 1 base error, 2 nocall correction
ccctcatctt

SEQ ID NO: 1821 - DNA, 10 bp, Artificial Sequence
  synthetic Reed-Solomon code for 8+2 base, 1 base error, 2 nocall correction
agctcatcgc

SEQ ID NO: 1822 - DNA, 10 bp, Artificial Sequence
  synthetic Reed-Solomon code for 8+2 base, 1 base error, 2 nocall correction
gattcatccc

SEQ ID NO: 1823 - DNA, 10 bp, Artificial Sequence
  synthetic Reed-Solomon code for 8+2 base, 1 base error, 2 nocall correction
tcttcatctc

SEQ ID NO: 1824 - DNA, 10 bp, Artificial Sequence
  synthetic Reed-Solomon code for 8+2 base, 1 base error, 2 nocall correction
ttttcatcga

SEQ ID NO: 1825 - DNA, 10 bp, Artificial Sequence
  synthetic Reed-Solomon code for 8+2 base, 1 base error, 2 nocall correction
caaagatcgt

SEQ ID NO: 1826 - DNA, 10 bp, Artificial Sequence
  synthetic Reed-Solomon code for 8+2 base, 1 base error, 2 nocall correction
aggagatcac

SEQ ID NO: 1827 - DNA, 10 bp, Artificial Sequence
  synthetic Reed-Solomon code for 8+2 base, 1 base error, 2 nocall correction
attcgatctg

SEQ ID NO: 1828 - DNA, 10 bp, Artificial Sequence
  synthetic Reed-Solomon code for 8+2 base, 1 base error, 2 nocall correction
aaaggatcgc

SEQ ID NO: 1829 - DNA, 10 bp, Artificial Sequence
  synthetic Reed-Solomon code for 8+2 base, 1 base error, 2 nocall correction
gtaggatcag

SEQ ID NO: 1830 - DNA, 10 bp, Artificial Sequence
  synthetic Reed-Solomon code for 8+2 base, 1 base error, 2 nocall correction
cacggatcga

SEQ ID NO: 1831 - DNA, 10 bp, Artificial Sequence
  synthetic Reed-Solomon code for 8+2 base, 1 base error, 2 nocall correction
cggggatcat

SEQ ID NO: 1832 - DNA, 10 bp, Artificial Sequence
  synthetic Reed-Solomon code for 8+2 base, 1 base error, 2 nocall correction
atgggatcaa

SEQ ID NO: 1833 - DNA, 10 bp, Artificial Sequence
  synthetic Reed-Solomon code for 8+2 base, 1 base error, 2 nocall correction
ttgggatccg

SEQ ID NO: 1834 - DNA, 10 bp, Artificial Sequence
  synthetic Reed-Solomon code for 8+2 base, 1 base error, 2 nocall correction
gttggatcct

SEQ ID NO: 1835 - DNA, 10 bp, Artificial Sequence
  synthetic Reed-Solomon code for 8+2 base, 1 base error, 2 nocall correction
acctgatccg

SEQ ID NO: 1836 - DNA, 10 bp, Artificial Sequence
  synthetic Reed-Solomon code for 8+2 base, 1 base error, 2 nocall correction
tcctgatcaa

SEQ ID NO: 1837 - DNA, 10 bp, Artificial Sequence
  synthetic Reed-Solomon code for 8+2 base, 1 base error, 2 nocall correction
gcaatatcat

SEQ ID NO: 1838 - DNA, 10 bp, Artificial Sequence
  synthetic Reed-Solomon code for 8+2 base, 1 base error, 2 nocall correction
gagatatctt

SEQ ID NO: 1839 - DNA, 10 bp, Artificial Sequence
  synthetic Reed-Solomon code for 8+2 base, 1 base error, 2 nocall correction
tcgatatcct

SEQ ID NO: 1840 - DNA, 10 bp, Artificial Sequence
  synthetic Reed-Solomon code for 8+2 base, 1 base error, 2 nocall correction
tatatatctg

SEQ ID NO: 1841 - DNA, 10 bp, Artificial Sequence
  synthetic Reed-Solomon code for 8+2 base, 1 base error, 2 nocall correction
gctatatccg

SEQ ID NO: 1842 - DNA, 10 bp, Artificial Sequence
  synthetic Reed-Solomon code for 8+2 base, 1 base error, 2 nocall correction
tgactatcga

SEQ ID NO: 1843 - DNA, 10 bp, Artificial Sequence
  synthetic Reed-Solomon code for 8+2 base, 1 base error, 2 nocall correction
gacctatcct

SEQ ID NO: 1844 - DNA, 10 bp, Artificial Sequence
  synthetic Reed-Solomon code for 8+2 base, 1 base error, 2 nocall correction
tccctatctt

SEQ ID NO: 1845 - DNA, 10 bp, Artificial Sequence
  synthetic Reed-Solomon code for 8+2 base, 1 base error, 2 nocall correction
cctctatctc

SEQ ID NO: 1846 - DNA, 10 bp, Artificial Sequence
  synthetic Reed-Solomon code for 8+2 base, 1 base error, 2 nocall correction
agtctatcgt

SEQ ID NO: 1847 - DNA, 10 bp, Artificial Sequence
  synthetic Reed-Solomon code for 8+2 base, 1 base error, 2 nocall correction
cttctatcga

SEQ ID NO: 1848 - DNA, 10 bp, Artificial Sequence
  synthetic Reed-Solomon code for 8+2 base, 1 base error, 2 nocall correction
aacgtatctg

SEQ ID NO: 1849 - DNA, 10 bp, Artificial Sequence
  synthetic Reed-Solomon code for 8+2 base, 1 base error, 2 nocall correction
gccgtatcaa

SEQ ID NO: 1850 - DNA, 10 bp, Artificial Sequence
  synthetic Reed-Solomon code for 8+2 base, 1 base error, 2 nocall correction
cgattatcct

SEQ ID NO: 1851 - DNA, 10 bp, Artificial Sequence
  synthetic Reed-Solomon code for 8+2 base, 1 base error, 2 nocall correction
atattatcca

SEQ ID NO: 1852 - DNA, 10 bp, Artificial Sequence
  synthetic Reed-Solomon code for 8+2 base, 1 base error, 2 nocall correction
ttattatcag

SEQ ID NO: 1853 - DNA, 10 bp, Artificial Sequence
  synthetic Reed-Solomon code for 8+2 base, 1 base error, 2 nocall correction
ctcttatccc

SEQ ID NO: 1854 - DNA, 10 bp, Artificial Sequence
  synthetic Reed-Solomon code for 8+2 base, 1 base error, 2 nocall correction
gtgttatccg

SEQ ID NO: 1855 - DNA, 10 bp, Artificial Sequence
  synthetic Reed-Solomon code for 8+2 base, 1 base error, 2 nocall correction
cgtttatcag

SEQ ID NO: 1856 - DNA, 10 bp, Artificial Sequence
  synthetic Reed-Solomon code for 8+2 base, 1 base error, 2 nocall correction
tttttatcct

SEQ ID NO: 1857 - DNA, 10 bp, Artificial Sequence
  synthetic Reed-Solomon code for 8+2 base, 1 base error, 2 nocall correction
ttaaactcac

SEQ ID NO: 1858 - DNA, 10 bp, Artificial Sequence
  synthetic Reed-Solomon code for 8+2 base, 1 base error, 2 nocall correction
tgcaactcat

SEQ ID NO: 1859 - DNA, 10 bp, Artificial Sequence
  synthetic Reed-Solomon code for 8+2 base, 1 base error, 2 nocall correction
ctcaactccg

SEQ ID NO: 1860 - DNA, 10 bp, Artificial Sequence
  synthetic Reed-Solomon code for 8+2 base, 1 base error, 2 nocall correction
tagaactcga

SEQ ID NO: 1861 - DNA, 10 bp, Artificial Sequence
  synthetic Reed-Solomon code for 8+2 base, 1 base error, 2 nocall correction
gtgaactccc

SEQ ID NO: 1862 - DNA, 10 bp, Artificial Sequence
  synthetic Reed-Solomon code for 8+2 base, 1 base error, 2 nocall correction
cgtaactcac

SEQ ID NO: 1863 - DNA, 10 bp, Artificial Sequence
  synthetic Reed-Solomon code for 8+2 base, 1 base error, 2 nocall correction
ggacactctt

SEQ ID NO: 1864 - DNA, 10 bp, Artificial Sequence
  synthetic Reed-Solomon code for 8+2 base, 1 base error, 2 nocall correction
gcccactcga

SEQ ID NO: 1865 - DNA, 10 bp, Artificial Sequence
  synthetic Reed-Solomon code for 8+2 base, 1 base error, 2 nocall correction
gtccactctc

SEQ ID NO: 1866 - DNA, 10 bp, Artificial Sequence
  synthetic Reed-Solomon code for 8+2 base, 1 base error, 2 nocall correction
ctgcactctg

SEQ ID NO: 1867 - DNA, 10 bp, Artificial Sequence
  synthetic Reed-Solomon code for 8+2 base, 1 base error, 2 nocall correction
agagactccg

SEQ ID NO: 1868 - DNA, 10 bp, Artificial Sequence
  synthetic Reed-Solomon code for 8+2 base, 1 base error, 2 nocall correction
tgagactcaa

SEQ ID NO: 1869 - DNA, 10 bp, Artificial Sequence
  synthetic Reed-Solomon code for 8+2 base, 1 base error, 2 nocall correction
ggggactcca

SEQ ID NO: 1870 - DNA, 10 bp, Artificial Sequence
  synthetic Reed-Solomon code for 8+2 base, 1 base error, 2 nocall correction
agtgactcat

SEQ ID NO: 1871 - DNA, 10 bp, Artificial Sequence
  synthetic Reed-Solomon code for 8+2 base, 1 base error, 2 nocall correction
cttgactcaa

SEQ ID NO: 1872 - DNA, 10 bp, Artificial Sequence
  synthetic Reed-Solomon code for 8+2 base, 1 base error, 2 nocall correction
cactactctt

SEQ ID NO: 1873 - DNA, 10 bp, Artificial Sequence
  synthetic Reed-Solomon code for 8+2 base, 1 base error, 2 nocall correction
tattactctc

SEQ ID NO: 1874 - DNA, 10 bp, Artificial Sequence
  synthetic Reed-Solomon code for 8+2 base, 1 base error, 2 nocall correction
gcttactccc

SEQ ID NO: 1875 - DNA, 10 bp, Artificial Sequence
  synthetic Reed-Solomon code for 8+2 base, 1 base error, 2 nocall correction
gcaacctcgc

SEQ ID NO: 1876 - DNA, 10 bp, Artificial Sequence
  synthetic Reed-Solomon code for 8+2 base, 1 base error, 2 nocall correction
gtaacctcta

SEQ ID NO: 1877 - DNA, 10 bp, Artificial Sequence
  synthetic Reed-Solomon code for 8+2 base, 1 base error, 2 nocall correction
atgacctctg

SEQ ID NO: 1878 - DNA, 10 bp, Artificial Sequence
  synthetic Reed-Solomon code for 8+2 base, 1 base error, 2 nocall correction
atcccctccg

SEQ ID NO: 1879 - DNA, 10 bp, Artificial Sequence
  synthetic Reed-Solomon code for 8+2 base, 1 base error, 2 nocall correction
ttcccctcaa

SEQ ID NO: 1880 - DNA, 10 bp, Artificial Sequence
  synthetic Reed-Solomon code for 8+2 base, 1 base error, 2 nocall correction
agtccctcac

SEQ ID NO: 1881 - DNA, 10 bp, Artificial Sequence
  synthetic Reed-Solomon code for 8+2 base, 1 base error, 2 nocall correction
ggagcctctc

SEQ ID NO: 1882 - DNA, 10 bp, Artificial Sequence
  synthetic Reed-Solomon code for 8+2 base, 1 base error, 2 nocall correction
gtcgcctctt

SEQ ID NO: 1883 - DNA, 10 bp, Artificial Sequence
  synthetic Reed-Solomon code for 8+2 base, 1 base error, 2 nocall correction
tgctcctcgg

SEQ ID NO: 1884 - DNA, 10 bp, Artificial Sequence
  synthetic Reed-Solomon code for 8+2 base, 1 base error, 2 nocall correction
aagtcctcct

SEQ ID NO: 1885 - DNA, 10 bp, Artificial Sequence
  synthetic Reed-Solomon code for 8+2 base, 1 base error, 2 nocall correction
gattcctcaa

SEQ ID NO: 1886 - DNA, 10 bp, Artificial Sequence
  synthetic Reed-Solomon code for 8+2 base, 1 base error, 2 nocall correction
acttcctctg

SEQ ID NO: 1887 - DNA, 10 bp, Artificial Sequence
  synthetic Reed-Solomon code for 8+2 base, 1 base error, 2 nocall correction
ggaagctccg

SEQ ID NO: 1888 - DNA, 10 bp, Artificial Sequence
  synthetic Reed-Solomon code for 8+2 base, 1 base error, 2 nocall correction
aggagctcca

SEQ ID NO: 1889 - DNA, 10 bp, Artificial Sequence
  synthetic Reed-Solomon code for 8+2 base, 1 base error, 2 nocall correction
tggagctcag

SEQ ID NO: 1890 - DNA, 10 bp, Artificial Sequence
  synthetic Reed-Solomon code for 8+2 base, 1 base error, 2 nocall correction
ctgagctcct

SEQ ID NO: 1891 - DNA, 10 bp, Artificial Sequence
  synthetic Reed-Solomon code for 8+2 base, 1 base error, 2 nocall correction
ggtagctcat

SEQ ID NO: 1892 - DNA, 10 bp, Artificial Sequence
  synthetic Reed-Solomon code for 8+2 base, 1 base error, 2 nocall correction
acacgctcgt

SEQ ID NO: 1893 - DNA, 10 bp, Artificial Sequence
  synthetic Reed-Solomon code for 8+2 base, 1 base error, 2 nocall correction
cgacgctctc

SEQ ID NO: 1894 - DNA, 10 bp, Artificial Sequence
  synthetic Reed-Solomon code for 8+2 base, 1 base error, 2 nocall correction
agccgctcta

SEQ ID NO: 1895 - DNA, 10 bp, Artificial Sequence
  synthetic Reed-Solomon code for 8+2 base, 1 base error, 2 nocall correction
ctccgctctt

SEQ ID NO: 1896 - DNA, 10 bp, Artificial Sequence
  synthetic Reed-Solomon code for 8+2 base, 1 base error, 2 nocall correction
tctcgctcga

SEQ ID NO: 1897 - DNA, 10 bp, Artificial Sequence
  synthetic Reed-Solomon code for 8+2 base, 1 base error, 2 nocall correction
tttcgctctc

SEQ ID NO: 1898 - DNA, 10 bp, Artificial Sequence
  synthetic Reed-Solomon code for 8+2 base, 1 base error, 2 nocall correction
taaggctcgg

SEQ ID NO: 1899 - DNA, 10 bp, Artificial Sequence
  synthetic Reed-Solomon code for 8+2 base, 1 base error, 2 nocall correction
atgggctccc

SEQ ID NO: 1900 - DNA, 10 bp, Artificial Sequence
  synthetic Reed-Solomon code for 8+2 base, 1 base error, 2 nocall correction
ccatgctcag

SEQ ID NO: 1901 - DNA, 10 bp, Artificial Sequence
  synthetic Reed-Solomon code for 8+2 base, 1 base error, 2 nocall correction
gactgctctc

SEQ ID NO: 1902 - DNA, 10 bp, Artificial Sequence
  synthetic Reed-Solomon code for 8+2 base, 1 base error, 2 nocall correction
tcctgctccc

SEQ ID NO: 1903 - DNA, 10 bp, Artificial Sequence
  synthetic Reed-Solomon code for 8+2 base, 1 base error, 2 nocall correction
cagtgctctg

SEQ ID NO: 1904 - DNA, 10 bp, Artificial Sequence
  synthetic Reed-Solomon code for 8+2 base, 1 base error, 2 nocall correction
ccttgctcct

SEQ ID NO: 1905 - DNA, 10 bp, Artificial Sequence
  synthetic Reed-Solomon code for 8+2 base, 1 base error, 2 nocall correction
aatatctctc

SEQ ID NO: 1906 - DNA, 10 bp, Artificial Sequence
  synthetic Reed-Solomon code for 8+2 base, 1 base error, 2 nocall correction
cgcctctcgg

SEQ ID NO: 1907 - DNA, 10 bp, Artificial Sequence
  synthetic Reed-Solomon code for 8+2 base, 1 base error, 2 nocall correction
gggctctcgc

SEQ ID NO: 1908 - DNA, 10 bp, Artificial Sequence
  synthetic Reed-Solomon code for 8+2 base, 1 base error, 2 nocall correction
tacgtctctc

SEQ ID NO: 1909 - DNA, 10 bp, Artificial Sequence
  synthetic Reed-Solomon code for 8+2 base, 1 base error, 2 nocall correction
gccgtctccc

SEQ ID NO: 1910 - DNA, 10 bp, Artificial Sequence
  synthetic Reed-Solomon code for 8+2 base, 1 base error, 2 nocall correction
ccggtctccg

SEQ ID NO: 1911 - DNA, 10 bp, Artificial Sequence
  synthetic Reed-Solomon code for 8+2 base, 1 base error, 2 nocall correction
catgtctctt

SEQ ID NO: 1912 - DNA, 10 bp, Artificial Sequence
  synthetic Reed-Solomon code for 8+2 base, 1 base error, 2 nocall correction
gaattctcgg

SEQ ID NO: 1913 - DNA, 10 bp, Artificial Sequence
  synthetic Reed-Solomon code for 8+2 base, 1 base error, 2 nocall correction
atattctcac

SEQ ID NO: 1914 - DNA, 10 bp, Artificial Sequence
  synthetic Reed-Solomon code for 8+2 base, 1 base error, 2 nocall correction
agcttctcat

SEQ ID NO: 1915 - DNA, 10 bp, Artificial Sequence
  synthetic Reed-Solomon code for 8+2 base, 1 base error, 2 nocall correction
ctcttctcaa

SEQ ID NO: 1916 - DNA, 10 bp, Artificial Sequence
  synthetic Reed-Solomon code for 8+2 base, 1 base error, 2 nocall correction
aagttctcga

SEQ ID NO: 1917 - DNA, 10 bp, Artificial Sequence
  synthetic Reed-Solomon code for 8+2 base, 1 base error, 2 nocall correction
acaaagtctc

SEQ ID NO: 1918 - DNA, 10 bp, Artificial Sequence
  synthetic Reed-Solomon code for 8+2 base, 1 base error, 2 nocall correction
cgaaagtcgt

SEQ ID NO: 1919 - DNA, 10 bp, Artificial Sequence
  synthetic Reed-Solomon code for 8+2 base, 1 base error, 2 nocall correction
ataaagtcga

SEQ ID NO: 1920 - DNA, 10 bp, Artificial Sequence
  synthetic Reed-Solomon code for 8+2 base, 1 base error, 2 nocall correction
cccaagtcta

SEQ ID NO: 1921 - DNA, 10 bp, Artificial Sequence
  synthetic Reed-Solomon code for 8+2 base, 1 base error, 2 nocall correction
ctcaagtcgc

SEQ ID NO: 1922 - DNA, 10 bp, Artificial Sequence
  synthetic Reed-Solomon code for 8+2 base, 1 base error, 2 nocall correction
aagaagtcac

SEQ ID NO: 1923 - DNA, 10 bp, Artificial Sequence
  synthetic Reed-Solomon code for 8+2 base, 1 base error, 2 nocall correction
gtgaagtcgg

SEQ ID NO: 1924 - DNA, 10 bp, Artificial Sequence
  synthetic Reed-Solomon code for 8+2 base, 1 base error, 2 nocall correction
tttaagtcgt

SEQ ID NO: 1925 - DNA, 10 bp, Artificial Sequence
  synthetic Reed-Solomon code for 8+2 base, 1 base error, 2 nocall correction
ccgcagtcca

SEQ ID NO: 1926 - DNA, 10 bp, Artificial Sequence
  synthetic Reed-Solomon code for 8+2 base, 1 base error, 2 nocall correction
ccagagtctt

SEQ ID NO: 1927 - DNA, 10 bp, Artificial Sequence
  synthetic Reed-Solomon code for 8+2 base, 1 base error, 2 nocall correction
agagagtcgc

SEQ ID NO: 1928 - DNA, 10 bp, Artificial Sequence
  synthetic Reed-Solomon code for 8+2 base, 1 base error, 2 nocall correction
cgcgagtcga

SEQ ID NO: 1929 - DNA, 10 bp, Artificial Sequence
  synthetic Reed-Solomon code for 8+2 base, 1 base error, 2 nocall correction
atcgagtcgt

SEQ ID NO: 1930 - DNA, 10 bp, Artificial Sequence
  synthetic Reed-Solomon code for 8+2 base, 1 base error, 2 nocall correction
caggagtcat

SEQ ID NO: 1931 - DNA, 10 bp, Artificial Sequence
  synthetic Reed-Solomon code for 8+2 base, 1 base error, 2 nocall correction
tcgtagtcgt

SEQ ID NO: 1932 - DNA, 10 bp, Artificial Sequence
  synthetic Reed-Solomon code for 8+2 base, 1 base error, 2 nocall correction
gcttagtcgg

SEQ ID NO: 1933 - DNA, 10 bp, Artificial Sequence
  synthetic Reed-Solomon code for 8+2 base, 1 base error, 2 nocall correction
taaacgtctg

SEQ ID NO: 1934 - DNA, 10 bp, Artificial Sequence
  synthetic Reed-Solomon code for 8+2 base, 1 base error, 2 nocall correction
gcaacgtccg

SEQ ID NO: 1935 - DNA, 10 bp, Artificial Sequence
  synthetic Reed-Solomon code for 8+2 base, 1 base error, 2 nocall correction
acgacgtcca

SEQ ID NO: 1936 - DNA, 10 bp, Artificial Sequence
  synthetic Reed-Solomon code for 8+2 base, 1 base error, 2 nocall correction
tcgacgtcag

SEQ ID NO: 1937 - DNA, 10 bp, Artificial Sequence
  synthetic Reed-Solomon code for 8+2 base, 1 base error, 2 nocall correction
gctacgtcat

SEQ ID NO: 1938 - DNA, 10 bp, Artificial Sequence
  synthetic Reed-Solomon code for 8+2 base, 1 base error, 2 nocall correction
ccaccgtctc

SEQ ID NO: 1939 - DNA, 10 bp, Artificial Sequence
  synthetic Reed-Solomon code for 8+2 base, 1 base error, 2 nocall correction
agaccgtcgt

SEQ ID NO: 1940 - DNA, 10 bp, Artificial Sequence
  synthetic Reed-Solomon code for 8+2 base, 1 base error, 2 nocall correction
ctaccgtcga

SEQ ID NO: 1941 - DNA, 10 bp, Artificial Sequence
  synthetic Reed-Solomon code for 8+2 base, 1 base error, 2 nocall correction
gacccgtcag

SEQ ID NO: 1942 - DNA, 10 bp, Artificial Sequence
  synthetic Reed-Solomon code for 8+2 base, 1 base error, 2 nocall correction
accccgtcta

SEQ ID NO: 1943 - DNA, 10 bp, Artificial Sequence
  synthetic Reed-Solomon code for 8+2 base, 1 base error, 2 nocall correction
atcccgtcgc

SEQ ID NO: 1944 - DNA, 10 bp, Artificial Sequence
  synthetic Reed-Solomon code for 8+2 base, 1 base error, 2 nocall correction
cagccgtcac

SEQ ID NO: 1945 - DNA, 10 bp, Artificial Sequence
  synthetic Reed-Solomon code for 8+2 base, 1 base error, 2 nocall correction
tgtccgtcga

SEQ ID NO: 1946 - DNA, 10 bp, Artificial Sequence
  synthetic Reed-Solomon code for 8+2 base, 1 base error, 2 nocall correction
cgatcgtcag

SEQ ID NO: 1947 - DNA, 10 bp, Artificial Sequence
  synthetic Reed-Solomon code for 8+2 base, 1 base error, 2 nocall correction
ttatcgtcct

SEQ ID NO: 1948 - DNA, 10 bp, Artificial Sequence
  synthetic Reed-Solomon code for 8+2 base, 1 base error, 2 nocall correction
tgctcgtccc

SEQ ID NO: 1949 - DNA, 10 bp, Artificial Sequence
  synthetic Reed-Solomon code for 8+2 base, 1 base error, 2 nocall correction
gtgtcgtcat

SEQ ID NO: 1950 - DNA, 10 bp, Artificial Sequence
  synthetic Reed-Solomon code for 8+2 base, 1 base error, 2 nocall correction
cgttcgtcct

SEQ ID NO: 1951 - DNA, 10 bp, Artificial Sequence
  synthetic Reed-Solomon code for 8+2 base, 1 base error, 2 nocall correction
atttcgtcca

SEQ ID NO: 1952 - DNA, 10 bp, Artificial Sequence
  synthetic Reed-Solomon code for 8+2 base, 1 base error, 2 nocall correction
ttttcgtcag

SEQ ID NO: 1953 - DNA, 10 bp, Artificial Sequence
  synthetic Reed-Solomon code for 8+2 base, 1 base error, 2 nocall correction
ggaaggtcgc

SEQ ID NO: 1954 - DNA, 10 bp, Artificial Sequence
  synthetic Reed-Solomon code for 8+2 base, 1 base error, 2 nocall correction
gtcaggtcgt

SEQ ID NO: 1955 - DNA, 10 bp, Artificial Sequence
  synthetic Reed-Solomon code for 8+2 base, 1 base error, 2 nocall correction
cataggtcca

SEQ ID NO: 1956 - DNA, 10 bp, Artificial Sequence
  synthetic Reed-Solomon code for 8+2 base, 1 base error, 2 nocall correction
actcggtcac

SEQ ID NO: 1957 - DNA, 10 bp, Artificial Sequence
  synthetic Reed-Solomon code for 8+2 base, 1 base error, 2 nocall correction
taagggtccc

SEQ ID NO: 1958 - DNA, 10 bp, Artificial Sequence
  synthetic Reed-Solomon code for 8+2 base, 1 base error, 2 nocall correction
gcagggtctc

SEQ ID NO: 1959 - DNA, 10 bp, Artificial Sequence
  synthetic Reed-Solomon code for 8+2 base, 1 base error, 2 nocall correction
gtagggtcga

SEQ ID NO: 1960 - DNA, 10 bp, Artificial Sequence
  synthetic Reed-Solomon code for 8+2 base, 1 base error, 2 nocall correction
cacgggtcag

SEQ ID NO: 1961 - DNA, 10 bp, Artificial Sequence
  synthetic Reed-Solomon code for 8+2 base, 1 base error, 2 nocall correction
gaggggtcac

SEQ ID NO: 1962 - DNA, 10 bp, Artificial Sequence
  synthetic Reed-Solomon code for 8+2 base, 1 base error, 2 nocall correction
atggggtcgg

SEQ ID NO: 1963 - DNA, 10 bp, Artificial Sequence
  synthetic Reed-Solomon code for 8+2 base, 1 base error, 2 nocall correction
tcctggtcgg

SEQ ID NO: 1964 - DNA, 10 bp, Artificial Sequence
  synthetic Reed-Solomon code for 8+2 base, 1 base error, 2 nocall correction
agttggtctg

SEQ ID NO: 1965 - DNA, 10 bp, Artificial Sequence
  synthetic Reed-Solomon code for 8+2 base, 1 base error, 2 nocall correction
ggcatgtctg

SEQ ID NO: 1966 - DNA, 10 bp, Artificial Sequence
  synthetic Reed-Solomon code for 8+2 base, 1 base error, 2 nocall correction
acgatgtcgt

SEQ ID NO: 1967 - DNA, 10 bp, Artificial Sequence
  synthetic Reed-Solomon code for 8+2 base, 1 base error, 2 nocall correction
cggatgtctc

SEQ ID NO: 1968 - DNA, 10 bp, Artificial Sequence
  synthetic Reed-Solomon code for 8+2 base, 1 base error, 2 nocall correction
agactgtcca

SEQ ID NO: 1969 - DNA, 10 bp, Artificial Sequence
  synthetic Reed-Solomon code for 8+2 base, 1 base error, 2 nocall correction
tgactgtcag

SEQ ID NO: 1970 - DNA, 10 bp, Artificial Sequence
  synthetic Reed-Solomon code for 8+2 base, 1 base error, 2 nocall correction
ctactgtcct

SEQ ID NO: 1971 - DNA, 10 bp, Artificial Sequence
  synthetic Reed-Solomon code for 8+2 base, 1 base error, 2 nocall correction
cgcctgtccc

SEQ ID NO: 1972 - DNA, 10 bp, Artificial Sequence
  synthetic Reed-Solomon code for 8+2 base, 1 base error, 2 nocall correction
gggctgtccg

SEQ ID NO: 1973 - DNA, 10 bp, Artificial Sequence
  synthetic Reed-Solomon code for 8+2 base, 1 base error, 2 nocall correction
tgtctgtcct

SEQ ID NO: 1974 - DNA, 10 bp, Artificial Sequence
  synthetic Reed-Solomon code for 8+2 base, 1 base error, 2 nocall correction
cttctgtcag

SEQ ID NO: 1975 - DNA, 10 bp, Artificial Sequence
  synthetic Reed-Solomon code for 8+2 base, 1 base error, 2 nocall correction
gccgtgtcgg

SEQ ID NO: 1976 - DNA, 10 bp, Artificial Sequence
  synthetic Reed-Solomon code for 8+2 base, 1 base error, 2 nocall correction
ccggtgtcgc

SEQ ID NO: 1977 - DNA, 10 bp, Artificial Sequence
  synthetic Reed-Solomon code for 8+2 base, 1 base error, 2 nocall correction
agggtgtctt

SEQ ID NO: 1978 - DNA, 10 bp, Artificial Sequence
  synthetic Reed-Solomon code for 8+2 base, 1 base error, 2 nocall correction
ctggtgtcta

SEQ ID NO: 1979 - DNA, 10 bp, Artificial Sequence
  synthetic Reed-Solomon code for 8+2 base, 1 base error, 2 nocall correction
gaattgtccc

SEQ ID NO: 1980 - DNA, 10 bp, Artificial Sequence
  synthetic Reed-Solomon code for 8+2 base, 1 base error, 2 nocall correction
tcattgtctc

SEQ ID NO: 1981 - DNA, 10 bp, Artificial Sequence
  synthetic Reed-Solomon code for 8+2 base, 1 base error, 2 nocall correction
ttattgtcga

SEQ ID NO: 1982 - DNA, 10 bp, Artificial Sequence
  synthetic Reed-Solomon code for 8+2 base, 1 base error, 2 nocall correction
tagttgtcac

SEQ ID NO: 1983 - DNA, 10 bp, Artificial Sequence
  synthetic Reed-Solomon code for 8+2 base, 1 base error, 2 nocall correction
cgtttgtcga

SEQ ID NO: 1984 - DNA, 10 bp, Artificial Sequence
  synthetic Reed-Solomon code for 8+2 base, 1 base error, 2 nocall correction
attttgtcgt

SEQ ID NO: 1985 - DNA, 10 bp, Artificial Sequence
  synthetic Reed-Solomon code for 8+2 base, 1 base error, 2 nocall correction
cgaaattctg

SEQ ID NO: 1986 - DNA, 10 bp, Artificial Sequence
  synthetic Reed-Solomon code for 8+2 base, 1 base error, 2 nocall correction
gtgaattctt

SEQ ID NO: 1987 - DNA, 10 bp, Artificial Sequence
  synthetic Reed-Solomon code for 8+2 base, 1 base error, 2 nocall correction
tttaattctg

SEQ ID NO: 1988 - DNA, 10 bp, Artificial Sequence
  synthetic Reed-Solomon code for 8+2 base, 1 base error, 2 nocall correction
ggacattccc

SEQ ID NO: 1989 - DNA, 10 bp, Artificial Sequence
  synthetic Reed-Solomon code for 8+2 base, 1 base error, 2 nocall correction
gtccattcct

SEQ ID NO: 1990 - DNA, 10 bp, Artificial Sequence
  synthetic Reed-Solomon code for 8+2 base, 1 base error, 2 nocall correction
tggcattcac

SEQ ID NO: 1991 - DNA, 10 bp, Artificial Sequence
  synthetic Reed-Solomon code for 8+2 base, 1 base error, 2 nocall correction
catcattcga

SEQ ID NO: 1992 - DNA, 10 bp, Artificial Sequence
  synthetic Reed-Solomon code for 8+2 base, 1 base error, 2 nocall correction
ccagattcgg

SEQ ID NO: 1993 - DNA, 10 bp, Artificial Sequence
  synthetic Reed-Solomon code for 8+2 base, 1 base error, 2 nocall correction
atcgattctg

SEQ ID NO: 1994 - DNA, 10 bp, Artificial Sequence
  synthetic Reed-Solomon code for 8+2 base, 1 base error, 2 nocall correction
aaatattcca

SEQ ID NO: 1995 - DNA, 10 bp, Artificial Sequence
  synthetic Reed-Solomon code for 8+2 base, 1 base error, 2 nocall correction
taatattcag

SEQ ID NO: 1996 - DNA, 10 bp, Artificial Sequence
  synthetic Reed-Solomon code for 8+2 base, 1 base error, 2 nocall correction
cactattccc

SEQ ID NO: 1997 - DNA, 10 bp, Artificial Sequence
  synthetic Reed-Solomon code for 8+2 base, 1 base error, 2 nocall correction
gagtattccg

SEQ ID NO: 1998 - DNA, 10 bp, Artificial Sequence
  synthetic Reed-Solomon code for 8+2 base, 1 base error, 2 nocall correction
tcgtattctg

SEQ ID NO: 1999 - DNA, 10 bp, Artificial Sequence
  synthetic Reed-Solomon code for 8+2 base, 1 base error, 2 nocall correction
tattattcct

SEQ ID NO: 2000 - DNA, 10 bp, Artificial Sequence
  synthetic Reed-Solomon code for 8+2 base, 1 base error, 2 nocall correction
gcttattctt

SEQ ID NO: 2001 - DNA, 10 bp, Artificial Sequence
  synthetic Reed-Solomon code for 8+2 base, 1 base error, 2 nocall correction
taaacttcgt

SEQ ID NO: 2002 - DNA, 10 bp, Artificial Sequence
  synthetic Reed-Solomon code for 8+2 base, 1 base error, 2 nocall correction
ggcacttcca

SEQ ID NO: 2003 - DNA, 10 bp, Artificial Sequence
  synthetic Reed-Solomon code for 8+2 base, 1 base error, 2 nocall correction
aatacttcga

SEQ ID NO: 2004 - DNA, 10 bp, Artificial Sequence
  synthetic Reed-Solomon code for 8+2 base, 1 base error, 2 nocall correction
agaccttctg

SEQ ID NO: 2005 - DNA, 10 bp, Artificial Sequence
  synthetic Reed-Solomon code for 8+2 base, 1 base error, 2 nocall correction
gggccttcta

SEQ ID NO: 2006 - DNA, 10 bp, Artificial Sequence
  synthetic Reed-Solomon code for 8+2 base, 1 base error, 2 nocall correction
ggagcttcct

SEQ ID NO: 2007 - DNA, 10 bp, Artificial Sequence
  synthetic Reed-Solomon code for 8+2 base, 1 base error, 2 nocall correction
tacgcttcga

SEQ ID NO: 2008 - DNA, 10 bp, Artificial Sequence
  synthetic Reed-Solomon code for 8+2 base, 1 base error, 2 nocall correction
gtcgcttccc

SEQ ID NO: 2009 - DNA, 10 bp, Artificial Sequence
  synthetic Reed-Solomon code for 8+2 base, 1 base error, 2 nocall correction
tgggcttcat

SEQ ID NO: 2010 - DNA, 10 bp, Artificial Sequence
  synthetic Reed-Solomon code for 8+2 base, 1 base error, 2 nocall correction
ctggcttccg

SEQ ID NO: 2011 - DNA, 10 bp, Artificial Sequence
  synthetic Reed-Solomon code for 8+2 base, 1 base error, 2 nocall correction
ggtgcttcag

SEQ ID NO: 2012 - DNA, 10 bp, Artificial Sequence
  synthetic Reed-Solomon code for 8+2 base, 1 base error, 2 nocall correction
acatcttcac

SEQ ID NO: 2013 - DNA, 10 bp, Artificial Sequence
  synthetic Reed-Solomon code for 8+2 base, 1 base error, 2 nocall correction
ccctcttcaa

SEQ ID NO: 2014 - DNA, 10 bp, Artificial Sequence
  synthetic Reed-Solomon code for 8+2 base, 1 base error, 2 nocall correction
aagtcttctc

SEQ ID NO: 2015 - DNA, 10 bp, Artificial Sequence
  synthetic Reed-Solomon code for 8+2 base, 1 base error, 2 nocall correction
gtcagttctg

SEQ ID NO: 2016 - DNA, 10 bp, Artificial Sequence
  synthetic Reed-Solomon code for 8+2 base, 1 base error, 2 nocall correction
ccgagttcga

SEQ ID NO: 2017 - DNA, 10 bp, Artificial Sequence
  synthetic Reed-Solomon code for 8+2 base, 1 base error, 2 nocall correction
ctgagttctc

SEQ ID NO: 2018 - DNA, 10 bp, Artificial Sequence
  synthetic Reed-Solomon code for 8+2 base, 1 base error, 2 nocall correction
cgacgttcct

SEQ ID NO: 2019 - DNA, 10 bp, Artificial Sequence
  synthetic Reed-Solomon code for 8+2 base, 1 base error, 2 nocall correction
atacgttcca

SEQ ID NO: 2020 - DNA, 10 bp, Artificial Sequence
  synthetic Reed-Solomon code for 8+2 base, 1 base error, 2 nocall correction
ttacgttcag

SEQ ID NO: 2021 - DNA, 10 bp, Artificial Sequence
  synthetic Reed-Solomon code for 8+2 base, 1 base error, 2 nocall correction
ctccgttccc

SEQ ID NO: 2022 - DNA, 10 bp, Artificial Sequence
  synthetic Reed-Solomon code for 8+2 base, 1 base error, 2 nocall correction
gtgcgttccg

SEQ ID NO: 2023 - DNA, 10 bp, Artificial Sequence
  synthetic Reed-Solomon code for 8+2 base, 1 base error, 2 nocall correction
cgtcgttcag

SEQ ID NO: 2024 - DNA, 10 bp, Artificial Sequence
  synthetic Reed-Solomon code for 8+2 base, 1 base error, 2 nocall correction
tttcgttcct

SEQ ID NO: 2025 - DNA, 10 bp, Artificial Sequence
  synthetic Reed-Solomon code for 8+2 base, 1 base error, 2 nocall correction
cggggttcta

SEQ ID NO: 2026 - DNA, 10 bp, Artificial Sequence
  synthetic Reed-Solomon code for 8+2 base, 1 base error, 2 nocall correction
atgggttctt

SEQ ID NO: 2027 - DNA, 10 bp, Artificial Sequence
  synthetic Reed-Solomon code for 8+2 base, 1 base error, 2 nocall correction
tgatgttcga

SEQ ID NO: 2028 - DNA, 10 bp, Artificial Sequence
  synthetic Reed-Solomon code for 8+2 base, 1 base error, 2 nocall correction
gactgttcct

SEQ ID NO: 2029 - DNA, 10 bp, Artificial Sequence
  synthetic Reed-Solomon code for 8+2 base, 1 base error, 2 nocall correction
tcctgttctt

SEQ ID NO: 2030 - DNA, 10 bp, Artificial Sequence
  synthetic Reed-Solomon code for 8+2 base, 1 base error, 2 nocall correction
ccttgttctc

SEQ ID NO: 2031 - DNA, 10 bp, Artificial Sequence
  synthetic Reed-Solomon code for 8+2 base, 1 base error, 2 nocall correction
agttgttcgt

SEQ ID NO: 2032 - DNA, 10 bp, Artificial Sequence
  synthetic Reed-Solomon code for 8+2 base, 1 base error, 2 nocall correction
ctttgttcga

SEQ ID NO: 2033 - DNA, 10 bp, Artificial Sequence
  synthetic Reed-Solomon code for 8+2 base, 1 base error, 2 nocall correction
aaaatttcag

SEQ ID NO: 2034 - DNA, 10 bp, Artificial Sequence
  synthetic Reed-Solomon code for 8+2 base, 1 base error, 2 nocall correction
taaatttcca

SEQ ID NO: 2035 - DNA, 10 bp, Artificial Sequence
  synthetic Reed-Solomon code for 8+2 base, 1 base error, 2 nocall correction
gcaatttcta

SEQ ID NO: 2036 - DNA, 10 bp, Artificial Sequence
  synthetic Reed-Solomon code for 8+2 base, 1 base error, 2 nocall correction
gtaatttcgc

SEQ ID NO: 2037 - DNA, 10 bp, Artificial Sequence
  synthetic Reed-Solomon code for 8+2 base, 1 base error, 2 nocall correction
ggcatttcgt

SEQ ID NO: 2038 - DNA, 10 bp, Artificial Sequence
  synthetic Reed-Solomon code for 8+2 base, 1 base error, 2 nocall correction
gagatttcaa

SEQ ID NO: 2039 - DNA, 10 bp, Artificial Sequence
  synthetic Reed-Solomon code for 8+2 base, 1 base error, 2 nocall correction
acgatttctg

SEQ ID NO: 2040 - DNA, 10 bp, Artificial Sequence
  synthetic Reed-Solomon code for 8+2 base, 1 base error, 2 nocall correction
aatatttcct

SEQ ID NO: 2041 - DNA, 10 bp, Artificial Sequence
  synthetic Reed-Solomon code for 8+2 base, 1 base error, 2 nocall correction
accctttccg

SEQ ID NO: 2042 - DNA, 10 bp, Artificial Sequence
  synthetic Reed-Solomon code for 8+2 base, 1 base error, 2 nocall correction
tccctttcaa

SEQ ID NO: 2043 - DNA, 10 bp, Artificial Sequence
  synthetic Reed-Solomon code for 8+2 base, 1 base error, 2 nocall correction
ggagtttcga

SEQ ID NO: 2044 - DNA, 10 bp, Artificial Sequence
  synthetic Reed-Solomon code for 8+2 base, 1 base error, 2 nocall correction
tacgtttcct

SEQ ID NO: 2045 - DNA, 10 bp, Artificial Sequence
  synthetic Reed-Solomon code for 8+2 base, 1 base error, 2 nocall correction
gccgtttctt

SEQ ID NO: 2046 - DNA, 10 bp, Artificial Sequence
  synthetic Reed-Solomon code for 8+2 base, 1 base error, 2 nocall correction
agggtttcgg

SEQ ID NO: 2047 - DNA, 10 bp, Artificial Sequence
  synthetic Reed-Solomon code for 8+2 base, 1 base error, 2 nocall correction
catgtttccc

SEQ ID NO: 2048 - DNA, 10 bp, Artificial Sequence
  synthetic Reed-Solomon code for 8+2 base, 1 base error, 2 nocall correction
attttttctg

SEQ ID NO: 2049 - DNA, 10 bp, Artificial Sequence
  synthetic Reed-Solomon code for 8+2 base, 1 base error, 2 nocall correction
tgaaaaagga

SEQ ID NO: 2050 - DNA, 10 bp, Artificial Sequence
  synthetic Reed-Solomon code for 8+2 base, 1 base error, 2 nocall correction
gacaaaagct

SEQ ID NO: 2051 - DNA, 10 bp, Artificial Sequence
  synthetic Reed-Solomon code for 8+2 base, 1 base error, 2 nocall correction
tccaaaagtt

SEQ ID NO: 2052 - DNA, 10 bp, Artificial Sequence
  synthetic Reed-Solomon code for 8+2 base, 1 base error, 2 nocall correction
cctaaaagtc

SEQ ID NO: 2053 - DNA, 10 bp, Artificial Sequence
  synthetic Reed-Solomon code for 8+2 base, 1 base error, 2 nocall correction
agtaaaaggt

SEQ ID NO: 2054 - DNA, 10 bp, Artificial Sequence
  synthetic Reed-Solomon code for 8+2 base, 1 base error, 2 nocall correction
cttaaaagga

SEQ ID NO: 2055 - DNA, 10 bp, Artificial Sequence
  synthetic Reed-Solomon code for 8+2 base, 1 base error, 2 nocall correction
gcacaaagat

SEQ ID NO: 2056 - DNA, 10 bp, Artificial Sequence
  synthetic Reed-Solomon code for 8+2 base, 1 base error, 2 nocall correction
gagcaaagtt

SEQ ID NO: 2057 - DNA, 10 bp, Artificial Sequence
  synthetic Reed-Solomon code for 8+2 base, 1 base error, 2 nocall correction
tcgcaaagct

SEQ ID NO: 2058 - DNA, 10 bp, Artificial Sequence
  synthetic Reed-Solomon code for 8+2 base, 1 base error, 2 nocall correction
tatcaaagtg

SEQ ID NO: 2059 - DNA, 10 bp, Artificial Sequence
  synthetic Reed-Solomon code for 8+2 base, 1 base error, 2 nocall correction
gctcaaagcg

SEQ ID NO: 2060 - DNA, 10 bp, Artificial Sequence
  synthetic Reed-Solomon code for 8+2 base, 1 base error, 2 nocall correction
gaagaaagca

SEQ ID NO: 2061 - DNA, 10 bp, Artificial Sequence
  synthetic Reed-Solomon code for 8+2 base, 1 base error, 2 nocall correction
tcagaaagta

SEQ ID NO: 2062 - DNA, 10 bp, Artificial Sequence
  synthetic Reed-Solomon code for 8+2 base, 1 base error, 2 nocall correction
ttagaaaggc

SEQ ID NO: 2063 - DNA, 10 bp, Artificial Sequence
  synthetic Reed-Solomon code for 8+2 base, 1 base error, 2 nocall correction
tgcgaaaggt

SEQ ID NO: 2064 - DNA, 10 bp, Artificial Sequence
  synthetic Reed-Solomon code for 8+2 base, 1 base error, 2 nocall correction
aaggaaagcg

SEQ ID NO: 2065 - DNA, 10 bp, Artificial Sequence
  synthetic Reed-Solomon code for 8+2 base, 1 base error, 2 nocall correction
taggaaagaa

SEQ ID NO: 2066 - DNA, 10 bp, Artificial Sequence
  synthetic Reed-Solomon code for 8+2 base, 1 base error, 2 nocall correction
actgaaagtt

SEQ ID NO: 2067 - DNA, 10 bp, Artificial Sequence
  synthetic Reed-Solomon code for 8+2 base, 1 base error, 2 nocall correction
cgtgaaaggc

SEQ ID NO: 2068 - DNA, 10 bp, Artificial Sequence
  synthetic Reed-Solomon code for 8+2 base, 1 base error, 2 nocall correction
gtctaaagtg

SEQ ID NO: 2069 - DNA, 10 bp, Artificial Sequence
  synthetic Reed-Solomon code for 8+2 base, 1 base error, 2 nocall correction
ccgtaaagga

SEQ ID NO: 2070 - DNA, 10 bp, Artificial Sequence
  synthetic Reed-Solomon code for 8+2 base, 1 base error, 2 nocall correction
ctgtaaagtc

SEQ ID NO: 2071 - DNA, 10 bp, Artificial Sequence
  synthetic Reed-Solomon code for 8+2 base, 1 base error, 2 nocall correction
ttaccaaggt

SEQ ID NO: 2072 - DNA, 10 bp, Artificial Sequence
  synthetic Reed-Solomon code for 8+2 base, 1 base error, 2 nocall correction
tgcccaaggc

SEQ ID NO: 2073 - DNA, 10 bp, Artificial Sequence
  synthetic Reed-Solomon code for 8+2 base, 1 base error, 2 nocall correction
actccaagtc

SEQ ID NO: 2074 - DNA, 10 bp, Artificial Sequence
  synthetic Reed-Solomon code for 8+2 base, 1 base error, 2 nocall correction
cgtccaaggt

SEQ ID NO: 2075 - DNA, 10 bp, Artificial Sequence
  synthetic Reed-Solomon code for 8+2 base, 1 base error, 2 nocall correction
attccaagga

SEQ ID NO: 2076 - DNA, 10 bp, Artificial Sequence
  synthetic Reed-Solomon code for 8+2 base, 1 base error, 2 nocall correction
gcagcaagac

SEQ ID NO: 2077 - DNA, 10 bp, Artificial Sequence
  synthetic Reed-Solomon code for 8+2 base, 1 base error, 2 nocall correction
cacgcaagtg

SEQ ID NO: 2078 - DNA, 10 bp, Artificial Sequence
  synthetic Reed-Solomon code for 8+2 base, 1 base error, 2 nocall correction
gaggcaagtc

SEQ ID NO: 2079 - DNA, 10 bp, Artificial Sequence
  synthetic Reed-Solomon code for 8+2 base, 1 base error, 2 nocall correction
tcggcaagcc

SEQ ID NO: 2080 - DNA, 10 bp, Artificial Sequence
  synthetic Reed-Solomon code for 8+2 base, 1 base error, 2 nocall correction
agatcaagct

SEQ ID NO: 2081 - DNA, 10 bp, Artificial Sequence
  synthetic Reed-Solomon code for 8+2 base, 1 base error, 2 nocall correction
ctatcaagca

SEQ ID NO: 2082 - DNA, 10 bp, Artificial Sequence
  synthetic Reed-Solomon code for 8+2 base, 1 base error, 2 nocall correction
atctcaagcc

SEQ ID NO: 2083 - DNA, 10 bp, Artificial Sequence
  synthetic Reed-Solomon code for 8+2 base, 1 base error, 2 nocall correction
agttcaagag

SEQ ID NO: 2084 - DNA, 10 bp, Artificial Sequence
  synthetic Reed-Solomon code for 8+2 base, 1 base error, 2 nocall correction
tgttcaagca

SEQ ID NO: 2085 - DNA, 10 bp, Artificial Sequence
  synthetic Reed-Solomon code for 8+2 base, 1 base error, 2 nocall correction
aaaagaagca

SEQ ID NO: 2086 - DNA, 10 bp, Artificial Sequence
  synthetic Reed-Solomon code for 8+2 base, 1 base error, 2 nocall correction
taaagaagag

SEQ ID NO: 2087 - DNA, 10 bp, Artificial Sequence
  synthetic Reed-Solomon code for 8+2 base, 1 base error, 2 nocall correction
cacagaagcc

SEQ ID NO: 2088 - DNA, 10 bp, Artificial Sequence
  synthetic Reed-Solomon code for 8+2 base, 1 base error, 2 nocall correction
gagagaagcg

SEQ ID NO: 2089 - DNA, 10 bp, Artificial Sequence
  synthetic Reed-Solomon code for 8+2 base, 1 base error, 2 nocall correction
tcgagaagtg

SEQ ID NO: 2090 - DNA, 10 bp, Artificial Sequence
  synthetic Reed-Solomon code for 8+2 base, 1 base error, 2 nocall correction
tatagaagct

SEQ ID NO: 2091 - DNA, 10 bp, Artificial Sequence
  synthetic Reed-Solomon code for 8+2 base, 1 base error, 2 nocall correction
gctagaagtt

SEQ ID NO: 2092 - DNA, 10 bp, Artificial Sequence
  synthetic Reed-Solomon code for 8+2 base, 1 base error, 2 nocall correction
ccacgaagac

SEQ ID NO: 2093 - DNA, 10 bp, Artificial Sequence
  synthetic Reed-Solomon code for 8+2 base, 1 base error, 2 nocall correction
gaccgaagtg

SEQ ID NO: 2094 - DNA, 10 bp, Artificial Sequence
  synthetic Reed-Solomon code for 8+2 base, 1 base error, 2 nocall correction
acccgaagaa

SEQ ID NO: 2095 - DNA, 10 bp, Artificial Sequence
  synthetic Reed-Solomon code for 8+2 base, 1 base error, 2 nocall correction
tcccgaagcg

SEQ ID NO: 2096 - DNA, 10 bp, Artificial Sequence
  synthetic Reed-Solomon code for 8+2 base, 1 base error, 2 nocall correction
cagcgaagtc

SEQ ID NO: 2097 - DNA, 10 bp, Artificial Sequence
  synthetic Reed-Solomon code for 8+2 base, 1 base error, 2 nocall correction
aacggaagct

SEQ ID NO: 2098 - DNA, 10 bp, Artificial Sequence
  synthetic Reed-Solomon code for 8+2 base, 1 base error, 2 nocall correction
tggggaaggg

SEQ ID NO: 2099 - DNA, 10 bp, Artificial Sequence
  synthetic Reed-Solomon code for 8+2 base, 1 base error, 2 nocall correction
ggtggaaggt

SEQ ID NO: 2100 - DNA, 10 bp, Artificial Sequence
  synthetic Reed-Solomon code for 8+2 base, 1 base error, 2 nocall correction
cgatgaagtg

SEQ ID NO: 2101 - DNA, 10 bp, Artificial Sequence
  synthetic Reed-Solomon code for 8+2 base, 1 base error, 2 nocall correction
gtgtgaagtt

SEQ ID NO: 2102 - DNA, 10 bp, Artificial Sequence
  synthetic Reed-Solomon code for 8+2 base, 1 base error, 2 nocall correction
ttttgaagtg

SEQ ID NO: 2103 - DNA, 10 bp, Artificial Sequence
  synthetic Reed-Solomon code for 8+2 base, 1 base error, 2 nocall correction
gaactaaggc

SEQ ID NO: 2104 - DNA, 10 bp, Artificial Sequence
  synthetic Reed-Solomon code for 8+2 base, 1 base error, 2 nocall correction
atactaagag

SEQ ID NO: 2105 - DNA, 10 bp, Artificial Sequence
  synthetic Reed-Solomon code for 8+2 base, 1 base error, 2 nocall correction
ttactaagca

SEQ ID NO: 2106 - DNA, 10 bp, Artificial Sequence
  synthetic Reed-Solomon code for 8+2 base, 1 base error, 2 nocall correction
gtgctaagaa

SEQ ID NO: 2107 - DNA, 10 bp, Artificial Sequence
  synthetic Reed-Solomon code for 8+2 base, 1 base error, 2 nocall correction
cgtctaagca

SEQ ID NO: 2108 - DNA, 10 bp, Artificial Sequence
  synthetic Reed-Solomon code for 8+2 base, 1 base error, 2 nocall correction
attctaagct

SEQ ID NO: 2109 - DNA, 10 bp, Artificial Sequence
  synthetic Reed-Solomon code for 8+2 base, 1 base error, 2 nocall correction
ttggtaagtt

SEQ ID NO: 2110 - DNA, 10 bp, Artificial Sequence
  synthetic Reed-Solomon code for 8+2 base, 1 base error, 2 nocall correction
gttgtaagtg

SEQ ID NO: 2111 - DNA, 10 bp, Artificial Sequence
  synthetic Reed-Solomon code for 8+2 base, 1 base error, 2 nocall correction
agattaagga

SEQ ID NO: 2112 - DNA, 10 bp, Artificial Sequence
  synthetic Reed-Solomon code for 8+2 base, 1 base error, 2 nocall correction
ctattaaggt

SEQ ID NO: 2113 - DNA, 10 bp, Artificial Sequence
  synthetic Reed-Solomon code for 8+2 base, 1 base error, 2 nocall correction
accttaagtt

SEQ ID NO: 2114 - DNA, 10 bp, Artificial Sequence
  synthetic Reed-Solomon code for 8+2 base, 1 base error, 2 nocall correction
cgcttaaggc

SEQ ID NO: 2115 - DNA, 10 bp, Artificial Sequence
  synthetic Reed-Solomon code for 8+2 base, 1 base error, 2 nocall correction
gggttaaggg

SEQ ID NO: 2116 - DNA, 10 bp, Artificial Sequence
  synthetic Reed-Solomon code for 8+2 base, 1 base error, 2 nocall correction
tgtttaaggt

SEQ ID NO: 2117 - DNA, 10 bp, Artificial Sequence
  synthetic Reed-Solomon code for 8+2 base, 1 base error, 2 nocall correction
cgcaacaggg

SEQ ID NO: 2118 - DNA, 10 bp, Artificial Sequence
  synthetic Reed-Solomon code for 8+2 base, 1 base error, 2 nocall correction
gggaacaggc

SEQ ID NO: 2119 - DNA, 10 bp, Artificial Sequence
  synthetic Reed-Solomon code for 8+2 base, 1 base error, 2 nocall correction
aatcacagtc

SEQ ID NO: 2120 - DNA, 10 bp, Artificial Sequence
  synthetic Reed-Solomon code for 8+2 base, 1 base error, 2 nocall correction
gaagacagac

SEQ ID NO: 2121 - DNA, 10 bp, Artificial Sequence
  synthetic Reed-Solomon code for 8+2 base, 1 base error, 2 nocall correction
atagacaggg

SEQ ID NO: 2122 - DNA, 10 bp, Artificial Sequence
  synthetic Reed-Solomon code for 8+2 base, 1 base error, 2 nocall correction
cccgacagtg

SEQ ID NO: 2123 - DNA, 10 bp, Artificial Sequence
  synthetic Reed-Solomon code for 8+2 base, 1 base error, 2 nocall correction
taggacagcc

SEQ ID NO: 2124 - DNA, 10 bp, Artificial Sequence
  synthetic Reed-Solomon code for 8+2 base, 1 base error, 2 nocall correction
gcggacagtc

SEQ ID NO: 2125 - DNA, 10 bp, Artificial Sequence
  synthetic Reed-Solomon code for 8+2 base, 1 base error, 2 nocall correction
gtggacagga

SEQ ID NO: 2126 - DNA, 10 bp, Artificial Sequence
  synthetic Reed-Solomon code for 8+2 base, 1 base error, 2 nocall correction
ggttacagta

SEQ ID NO: 2127 - DNA, 10 bp, Artificial Sequence
  synthetic Reed-Solomon code for 8+2 base, 1 base error, 2 nocall correction
tacaccagtt

SEQ ID NO: 2128 - DNA, 10 bp, Artificial Sequence
  synthetic Reed-Solomon code for 8+2 base, 1 base error, 2 nocall correction
gccaccagct

SEQ ID NO: 2129 - DNA, 10 bp, Artificial Sequence
  synthetic Reed-Solomon code for 8+2 base, 1 base error, 2 nocall correction
cataccagtc

SEQ ID NO: 2130 - DNA, 10 bp, Artificial Sequence
  synthetic Reed-Solomon code for 8+2 base, 1 base error, 2 nocall correction
gaacccagat

SEQ ID NO: 2131 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
agccccaggg

SEQ ID NO: 2132 - DNA, 10 bp, Artificial Sequence
  synthetic Reed-Solomon code for 8+2 base, 1 base error, 2 nocall correction
tagcccagct

SEQ ID NO: 2133 - DNA, 10 bp, Artificial Sequence
  synthetic Reed-Solomon code for 8+2 base, 1 base error, 2 nocall correction
gcgcccagtt

SEQ ID NO: 2134 - DNA, 10 bp, Artificial Sequence
  synthetic Reed-Solomon code for 8+2 base, 1 base error, 2 nocall correction
gatcccagcg

SEQ ID NO: 2135 - DNA, 10 bp, Artificial Sequence
  synthetic Reed-Solomon code for 8+2 base, 1 base error, 2 nocall correction
tctcccagtg

SEQ ID NO: 2136 - DNA, 10 bp, Artificial Sequence
  synthetic Reed-Solomon code for 8+2 base, 1 base error, 2 nocall correction
taagccagta

SEQ ID NO: 2137 - DNA, 10 bp, Artificial Sequence
  synthetic Reed-Solomon code for 8+2 base, 1 base error, 2 nocall correction
gcagccagca

SEQ ID NO: 2138 - DNA, 10 bp, Artificial Sequence
  synthetic Reed-Solomon code for 8+2 base, 1 base error, 2 nocall correction
acggccagcg

SEQ ID NO: 2139 - DNA, 10 bp, Artificial Sequence
  synthetic Reed-Solomon code for 8+2 base, 1 base error, 2 nocall correction
tcggccagaa

SEQ ID NO: 2140 - DNA, 10 bp, Artificial Sequence
  synthetic Reed-Solomon code for 8+2 base, 1 base error, 2 nocall correction
aatgccagtt

SEQ ID NO: 2141 - DNA, 10 bp, Artificial Sequence
  synthetic Reed-Solomon code for 8+2 base, 1 base error, 2 nocall correction
ctatccagac

SEQ ID NO: 2142 - DNA, 10 bp, Artificial Sequence
  synthetic Reed-Solomon code for 8+2 base, 1 base error, 2 nocall correction
cgctccagat

SEQ ID NO: 2143 - DNA, 10 bp, Artificial Sequence
  synthetic Reed-Solomon code for 8+2 base, 1 base error, 2 nocall correction
atctccagaa

SEQ ID NO: 2144 - DNA, 10 bp, Artificial Sequence
  synthetic Reed-Solomon code for 8+2 base, 1 base error, 2 nocall correction
ttctccagcg

SEQ ID NO: 2145 - DNA, 10 bp, Artificial Sequence
  synthetic Reed-Solomon code for 8+2 base, 1 base error, 2 nocall correction
cagtccagga

SEQ ID NO: 2146 - DNA, 10 bp, Artificial Sequence
  synthetic Reed-Solomon code for 8+2 base, 1 base error, 2 nocall correction
tgttccagac

SEQ ID NO: 2147 - DNA, 10 bp, Artificial Sequence
  synthetic Reed-Solomon code for 8+2 base, 1 base error, 2 nocall correction
aaaagcagac

SEQ ID NO: 2148 - DNA, 10 bp, Artificial Sequence
  synthetic Reed-Solomon code for 8+2 base, 1 base error, 2 nocall correction
gtaagcaggg

SEQ ID NO: 2149 - DNA, 10 bp, Artificial Sequence
  synthetic Reed-Solomon code for 8+2 base, 1 base error, 2 nocall correction
cacagcagaa

SEQ ID NO: 2150 - DNA, 10 bp, Artificial Sequence
  synthetic Reed-Solomon code for 8+2 base, 1 base error, 2 nocall correction
acgagcagtc

SEQ ID NO: 2151 - DNA, 10 bp, Artificial Sequence
  synthetic Reed-Solomon code for 8+2 base, 1 base error, 2 nocall correction
cggagcaggt

SEQ ID NO: 2152 - DNA, 10 bp, Artificial Sequence
  synthetic Reed-Solomon code for 8+2 base, 1 base error, 2 nocall correction
atgagcagga

SEQ ID NO: 2153 - DNA, 10 bp, Artificial Sequence
  synthetic Reed-Solomon code for 8+2 base, 1 base error, 2 nocall correction
ccacgcagca

SEQ ID NO: 2154 - DNA, 10 bp, Artificial Sequence
  synthetic Reed-Solomon code for 8+2 base, 1 base error, 2 nocall correction
acccgcagcc

SEQ ID NO: 2155 - DNA, 10 bp, Artificial Sequence
  synthetic Reed-Solomon code for 8+2 base, 1 base error, 2 nocall correction
caaggcagat

SEQ ID NO: 2156 - DNA, 10 bp, Artificial Sequence
  synthetic Reed-Solomon code for 8+2 base, 1 base error, 2 nocall correction
ccgggcagtt

SEQ ID NO: 2157 - DNA, 10 bp, Artificial Sequence
  synthetic Reed-Solomon code for 8+2 base, 1 base error, 2 nocall correction
aggggcaggc

SEQ ID NO: 2158 - DNA, 10 bp, Artificial Sequence
  synthetic Reed-Solomon code for 8+2 base, 1 base error, 2 nocall correction
catggcagcg

SEQ ID NO: 2159 - DNA, 10 bp, Artificial Sequence
  synthetic Reed-Solomon code for 8+2 base, 1 base error, 2 nocall correction
tcatgcaggt

SEQ ID NO: 2160 - DNA, 10 bp, Artificial Sequence
  synthetic Reed-Solomon code for 8+2 base, 1 base error, 2 nocall correction
tgctgcagta

SEQ ID NO: 2161 - DNA, 10 bp, Artificial Sequence
  synthetic Reed-Solomon code for 8+2 base, 1 base error, 2 nocall correction
acttgcagga

SEQ ID NO: 2162 - DNA, 10 bp, Artificial Sequence
  synthetic Reed-Solomon code for 8+2 base, 1 base error, 2 nocall correction
atttgcagtc

SEQ ID NO: 2163 - DNA, 10 bp, Artificial Sequence
  synthetic Reed-Solomon code for 8+2 base, 1 base error, 2 nocall correction
ggaatcagtt

SEQ ID NO: 2164 - DNA, 10 bp, Artificial Sequence
  synthetic Reed-Solomon code for 8+2 base, 1 base error, 2 nocall correction
gccatcagga

SEQ ID NO: 2165 - DNA, 10 bp, Artificial Sequence
  synthetic Reed-Solomon code for 8+2 base, 1 base error, 2 nocall correction
gtcatcagtc

SEQ ID NO: 2166 - DNA, 10 bp, Artificial Sequence
  synthetic Reed-Solomon code for 8+2 base, 1 base error, 2 nocall correction
ctgatcagtg

SEQ ID NO: 2167 - DNA, 10 bp, Artificial Sequence
  synthetic Reed-Solomon code for 8+2 base, 1 base error, 2 nocall correction
ttactcagac

SEQ ID NO: 2168 - DNA, 10 bp, Artificial Sequence
  synthetic Reed-Solomon code for 8+2 base, 1 base error, 2 nocall correction
tgcctcagat

SEQ ID NO: 2169 - DNA, 10 bp, Artificial Sequence
  synthetic Reed-Solomon code for 8+2 base, 1 base error, 2 nocall correction
ctcctcagcg

SEQ ID NO: 2170 - DNA, 10 bp, Artificial Sequence
  synthetic Reed-Solomon code for 8+2 base, 1 base error, 2 nocall correction
tagctcagga

SEQ ID NO: 2171 - DNA, 10 bp, Artificial Sequence
  synthetic Reed-Solomon code for 8+2 base, 1 base error, 2 nocall correction
gtgctcagcc

SEQ ID NO: 2172 - DNA, 10 bp, Artificial Sequence
  synthetic Reed-Solomon code for 8+2 base, 1 base error, 2 nocall correction
cgtctcagac

SEQ ID NO: 2173 - DNA, 10 bp, Artificial Sequence
  synthetic Reed-Solomon code for 8+2 base, 1 base error, 2 nocall correction
gcagtcaggt

SEQ ID NO: 2174 - DNA, 10 bp, Artificial Sequence
  synthetic Reed-Solomon code for 8+2 base, 1 base error, 2 nocall correction
ggcgtcagta

SEQ ID NO: 2175 - DNA, 10 bp, Artificial Sequence
  synthetic Reed-Solomon code for 8+2 base, 1 base error, 2 nocall correction
cagttcagct

SEQ ID NO: 2176 - DNA, 10 bp, Artificial Sequence
  synthetic Reed-Solomon code for 8+2 base, 1 base error, 2 nocall correction
cctttcagtg

SEQ ID NO: 2177 - DNA, 10 bp, Artificial Sequence
  synthetic Reed-Solomon code for 8+2 base, 1 base error, 2 nocall correction
agaaagagca

SEQ ID NO: 2178 - DNA, 10 bp, Artificial Sequence
  synthetic Reed-Solomon code for 8+2 base, 1 base error, 2 nocall correction
tgaaagagag

SEQ ID NO: 2179 - DNA, 10 bp, Artificial Sequence
  synthetic Reed-Solomon code for 8+2 base, 1 base error, 2 nocall correction
ctaaagagct

SEQ ID NO: 2180 - DNA, 10 bp, Artificial Sequence
  synthetic Reed-Solomon code for 8+2 base, 1 base error, 2 nocall correction
cgcaagagcc

SEQ ID NO: 2181 - DNA, 10 bp, Artificial Sequence
  synthetic Reed-Solomon code for 8+2 base, 1 base error, 2 nocall correction
gggaagagcg

SEQ ID NO: 2182 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
tgtaagagct

SEQ ID NO: 2183 - DNA, 10 bp, Artificial Sequence
  synthetic Reed-Solomon code for 8+2 base, 1 base error, 2 nocall correction
cttaagagag

SEQ ID NO: 2184 - DNA, 10 bp, Artificial Sequence
  synthetic Reed-Solomon code for 8+2 base, 1 base error, 2 nocall correction
ggccagagtg

SEQ ID NO: 2185 - DNA, 10 bp, Artificial Sequence
  synthetic Reed-Solomon code for 8+2 base, 1 base error, 2 nocall correction
acgcagaggt

SEQ ID NO: 2186 - DNA, 10 bp, Artificial Sequence
  synthetic Reed-Solomon code for 8+2 base, 1 base error, 2 nocall correction
cggcagagtc

SEQ ID NO: 2187 - DNA, 10 bp, Artificial Sequence
  synthetic Reed-Solomon code for 8+2 base, 1 base error, 2 nocall correction
atagagagcc

SEQ ID NO: 2188 - DNA, 10 bp, Artificial Sequence
  synthetic Reed-Solomon code for 8+2 base, 1 base error, 2 nocall correction
agcgagagct

SEQ ID NO: 2189 - DNA, 10 bp, Artificial Sequence
  synthetic Reed-Solomon code for 8+2 base, 1 base error, 2 nocall correction
ctcgagagca

SEQ ID NO: 2190 - DNA, 10 bp, Artificial Sequence
  synthetic Reed-Solomon code for 8+2 base, 1 base error, 2 nocall correction
taggagaggg

SEQ ID NO: 2191 - DNA, 10 bp, Artificial Sequence
  synthetic Reed-Solomon code for 8+2 base, 1 base error, 2 nocall correction
gatgagaggt

SEQ ID NO: 2192 - DNA, 10 bp, Artificial Sequence
  synthetic Reed-Solomon code for 8+2 base, 1 base error, 2 nocall correction
caatagagtg

SEQ ID NO: 2193 - DNA, 10 bp, Artificial Sequence
  synthetic Reed-Solomon code for 8+2 base, 1 base error, 2 nocall correction
gcctagagac

SEQ ID NO: 2194 - DNA, 10 bp, Artificial Sequence
  synthetic Reed-Solomon code for 8+2 base, 1 base error, 2 nocall correction
ccgtagagag

SEQ ID NO: 2195 - DNA, 10 bp, Artificial Sequence
  synthetic Reed-Solomon code for 8+2 base, 1 base error, 2 nocall correction
ccgacgaggt

SEQ ID NO: 2196 - DNA, 10 bp, Artificial Sequence
  synthetic Reed-Solomon code for 8+2 base, 1 base error, 2 nocall correction
aggacgagtc

SEQ ID NO: 2197 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
cgaccgagca

SEQ ID NO: 2198 - DNA, 10 bp, Artificial Sequence
  synthetic Reed-Solomon code for 8+2 base, 1 base error, 2 nocall correction
ataccgagct

SEQ ID NO: 2199 - DNA, 10 bp, Artificial Sequence
  synthetic Reed-Solomon code for 8+2 base, 1 base error, 2 nocall correction
agcccgagcc

SEQ ID NO: 2200 - DNA, 10 bp, Artificial Sequence
  synthetic Reed-Solomon code for 8+2 base, 1 base error, 2 nocall correction
gatccgaggc

SEQ ID NO: 2201 - DNA, 10 bp, Artificial Sequence
  synthetic Reed-Solomon code for 8+2 base, 1 base error, 2 nocall correction
attccgagag

SEQ ID NO: 2202 - DNA, 10 bp, Artificial Sequence
  synthetic Reed-Solomon code for 8+2 base, 1 base error, 2 nocall correction
tttccgagca

SEQ ID NO: 2203 - DNA, 10 bp, Artificial Sequence
  synthetic Reed-Solomon code for 8+2 base, 1 base error, 2 nocall correction
gtagcgagtg

SEQ ID NO: 2204 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
acggcgaggc

SEQ ID NO: 2205 - DNA, 10 bp, Artificial Sequence
  synthetic Reed-Solomon code for 8+2 base, 1 base error, 2 nocall correction
cgggcgagtt

SEQ ID NO: 2206 - DNA, 10 bp, Artificial Sequence
  synthetic Reed-Solomon code for 8+2 base, 1 base error, 2 nocall correction
atggcgagta

SEQ ID NO: 2207 - DNA, 10 bp, Artificial Sequence
  synthetic Reed-Solomon code for 8+2 base, 1 base error, 2 nocall correction
tgatcgaggt

SEQ ID NO: 2208 - DNA, 10 bp, Artificial Sequence
  synthetic Reed-Solomon code for 8+2 base, 1 base error, 2 nocall correction
gactcgagca

SEQ ID NO: 2209 - DNA, 10 bp, Artificial Sequence
  synthetic Reed-Solomon code for 8+2 base, 1 base error, 2 nocall correction
tcctcgagta

SEQ ID NO: 2210 - DNA, 10 bp, Artificial Sequence
  synthetic Reed-Solomon code for 8+2 base, 1 base error, 2 nocall correction
ttctcgaggc

SEQ ID NO: 2211 - DNA, 10 bp, Artificial Sequence
  synthetic Reed-Solomon code for 8+2 base, 1 base error, 2 nocall correction
agttcgagga

SEQ ID NO: 2212 - DNA, 10 bp, Artificial Sequence
  synthetic Reed-Solomon code for 8+2 base, 1 base error, 2 nocall correction
ctttcgaggt

SEQ ID NO: 2213 - DNA, 10 bp, Artificial Sequence
  synthetic Reed-Solomon code for 8+2 base, 1 base error, 2 nocall correction
taaaggagga

SEQ ID NO: 2214 - DNA, 10 bp, Artificial Sequence
  synthetic Reed-Solomon code for 8+2 base, 1 base error, 2 nocall correction
gtaaggagcc

SEQ ID NO: 2215 - DNA, 10 bp, Artificial Sequence
  synthetic Reed-Solomon code for 8+2 base, 1 base error, 2 nocall correction
ggcaggagct

SEQ ID NO: 2216 - DNA, 10 bp, Artificial Sequence
  synthetic Reed-Solomon code for 8+2 base, 1 base error, 2 nocall correction
ttgaggagac

SEQ ID NO: 2217 - DNA, 10 bp, Artificial Sequence
  synthetic Reed-Solomon code for 8+2 base, 1 base error, 2 nocall correction
aataggaggt

SEQ ID NO: 2218 - DNA, 10 bp, Artificial Sequence
  synthetic Reed-Solomon code for 8+2 base, 1 base error, 2 nocall correction
ctacggagtg

SEQ ID NO: 2219 - DNA, 10 bp, Artificial Sequence
  synthetic Reed-Solomon code for 8+2 base, 1 base error, 2 nocall correction
acccggaggg

SEQ ID NO: 2220 - DNA, 10 bp, Artificial Sequence
  synthetic Reed-Solomon code for 8+2 base, 1 base error, 2 nocall correction
gggcggagtt

SEQ ID NO: 2221 - DNA, 10 bp, Artificial Sequence
  synthetic Reed-Solomon code for 8+2 base, 1 base error, 2 nocall correction
tgtcggagtg

SEQ ID NO: 2222 - DNA, 10 bp, Artificial Sequence
  synthetic Reed-Solomon code for 8+2 base, 1 base error, 2 nocall correction
ggagggagca

SEQ ID NO: 2223 - DNA, 10 bp, Artificial Sequence
  synthetic Reed-Solomon code for 8+2 base, 1 base error, 2 nocall correction
tacgggaggt

SEQ ID NO: 2224 - DNA, 10 bp, Artificial Sequence
  synthetic Reed-Solomon code for 8+2 base, 1 base error, 2 nocall correction
agggggagcg

SEQ ID NO: 2225 - DNA, 10 bp, Artificial Sequence
  synthetic Reed-Solomon code for 8+2 base, 1 base error, 2 nocall correction
tgggggagaa

SEQ ID NO: 2226 - DNA, 10 bp, Artificial Sequence
  synthetic Reed-Solomon code for 8+2 base, 1 base error, 2 nocall correction
catgggaggc

SEQ ID NO: 2227 - DNA, 10 bp, Artificial Sequence
  synthetic Reed-Solomon code for 8+2 base, 1 base error, 2 nocall correction
ccctggagat

SEQ ID NO: 2228 - DNA, 10 bp, Artificial Sequence
  synthetic Reed-Solomon code for 8+2 base, 1 base error, 2 nocall correction
tcttggagac

SEQ ID NO: 2229 - DNA, 10 bp, Artificial Sequence
  synthetic Reed-Solomon code for 8+2 base, 1 base error, 2 nocall correction
ccgatgagca

SEQ ID NO: 2230 - DNA, 10 bp, Artificial Sequence
  synthetic Reed-Solomon code for 8+2 base, 1 base error, 2 nocall correction
acactgagtc

SEQ ID NO: 2231 - DNA, 10 bp, Artificial Sequence
  synthetic Reed-Solomon code for 8+2 base, 1 base error, 2 nocall correction
cgactgaggt

SEQ ID NO: 2232 - DNA, 10 bp, Artificial Sequence
  synthetic Reed-Solomon code for 8+2 base, 1 base error, 2 nocall correction
atactgagga

SEQ ID NO: 2233 - DNA, 10 bp, Artificial Sequence
  synthetic Reed-Solomon code for 8+2 base, 1 base error, 2 nocall correction
cccctgagta

SEQ ID NO: 2234 - DNA, 10 bp, Artificial Sequence
  synthetic Reed-Solomon code for 8+2 base, 1 base error, 2 nocall correction
ctcctgaggc

SEQ ID NO: 2235 - DNA, 10 bp, Artificial Sequence
  synthetic Reed-Solomon code for 8+2 base, 1 base error, 2 nocall correction
aagctgagac

SEQ ID NO: 2236 - DNA, 10 bp, Artificial Sequence
  synthetic Reed-Solomon code for 8+2 base, 1 base error, 2 nocall correction
gtgctgaggg

SEQ ID NO: 2237 - DNA, 10 bp, Artificial Sequence
  synthetic Reed-Solomon code for 8+2 base, 1 base error, 2 nocall correction
tttctgaggt

SEQ ID NO: 2238 - DNA, 10 bp, Artificial Sequence
  synthetic Reed-Solomon code for 8+2 base, 1 base error, 2 nocall correction
gctgtgagac

SEQ ID NO: 2239 - DNA, 10 bp, Artificial Sequence
  synthetic Reed-Solomon code for 8+2 base, 1 base error, 2 nocall correction
agattgagag

SEQ ID NO: 2240 - DNA, 10 bp, Artificial Sequence
  synthetic Reed-Solomon code for 8+2 base, 1 base error, 2 nocall correction
tgattgagca

SEQ ID NO: 2241 - DNA, 10 bp, Artificial Sequence
  synthetic Reed-Solomon code for 8+2 base, 1 base error, 2 nocall correction
gacttgaggt

SEQ ID NO: 2242 - DNA, 10 bp, Artificial Sequence
  synthetic Reed-Solomon code for 8+2 base, 1 base error, 2 nocall correction
gggttgagaa

SEQ ID NO: 2243 - DNA, 10 bp, Artificial Sequence
  synthetic Reed-Solomon code for 8+2 base, 1 base error, 2 nocall correction
agtttgagct

SEQ ID NO: 2244 - DNA, 10 bp, Artificial Sequence
  synthetic Reed-Solomon code for 8+2 base, 1 base error, 2 nocall correction
cttttgagca

SEQ ID NO: 2245 - DNA, 10 bp, Artificial Sequence
  synthetic Reed-Solomon code for 8+2 base, 1 base error, 2 nocall correction
accaatagcg

SEQ ID NO: 2246 - DNA, 10 bp, Artificial Sequence
  synthetic Reed-Solomon code for 8+2 base, 1 base error, 2 nocall correction
tccaatagaa

SEQ ID NO: 2247 - DNA, 10 bp, Artificial Sequence
  synthetic Reed-Solomon code for 8+2 base, 1 base error, 2 nocall correction
aaacatagag

SEQ ID NO: 2248 - DNA, 10 bp, Artificial Sequence
  synthetic Reed-Solomon code for 8+2 base, 1 base error, 2 nocall correction
taacatagca

SEQ ID NO: 2249 - DNA, 10 bp, Artificial Sequence
  synthetic Reed-Solomon code for 8+2 base, 1 base error, 2 nocall correction
gcacatagta

SEQ ID NO: 2250 - DNA, 10 bp, Artificial Sequence
  synthetic Reed-Solomon code for 8+2 base, 1 base error, 2 nocall correction
gtacataggc

SEQ ID NO: 2251 - DNA, 10 bp, Artificial Sequence
  synthetic Reed-Solomon code for 8+2 base, 1 base error, 2 nocall correction
ggccataggt

SEQ ID NO: 2252 - DNA, 10 bp, Artificial Sequence
  synthetic Reed-Solomon code for 8+2 base, 1 base error, 2 nocall correction
gagcatagaa

SEQ ID NO: 2253 - DNA, 10 bp, Artificial Sequence
  synthetic Reed-Solomon code for 8+2 base, 1 base error, 2 nocall correction
acgcatagtg

SEQ ID NO: 2254 - DNA, 10 bp, Artificial Sequence
  synthetic Reed-Solomon code for 8+2 base, 1 base error, 2 nocall correction
aatcatagct

SEQ ID NO: 2255 - DNA, 10 bp, Artificial Sequence
  synthetic Reed-Solomon code for 8+2 base, 1 base error, 2 nocall correction
tcagatagat

SEQ ID NO: 2256 - DNA, 10 bp, Artificial Sequence
  synthetic Reed-Solomon code for 8+2 base, 1 base error, 2 nocall correction
taggatagtt

SEQ ID NO: 2257 - DNA, 10 bp, Artificial Sequence
  synthetic Reed-Solomon code for 8+2 base, 1 base error, 2 nocall correction
gcggatagct

SEQ ID NO: 2258 - DNA, 10 bp, Artificial Sequence
  synthetic Reed-Solomon code for 8+2 base, 1 base error, 2 nocall correction
gatgatagtg

SEQ ID NO: 2259 - DNA, 10 bp, Artificial Sequence
  synthetic Reed-Solomon code for 8+2 base, 1 base error, 2 nocall correction
actgatagaa

SEQ ID NO: 2260 - DNA, 10 bp, Artificial Sequence
  synthetic Reed-Solomon code for 8+2 base, 1 base error, 2 nocall correction
tctgatagcg

SEQ ID NO: 2261 - DNA, 10 bp, Artificial Sequence
  synthetic Reed-Solomon code for 8+2 base, 1 base error, 2 nocall correction
caatataggt

SEQ ID NO: 2262 - DNA, 10 bp, Artificial Sequence
  synthetic Reed-Solomon code for 8+2 base, 1 base error, 2 nocall correction
aggtatagac

SEQ ID NO: 2263 - DNA, 10 bp, Artificial Sequence
  synthetic Reed-Solomon code for 8+2 base, 1 base error, 2 nocall correction
caaactagag

SEQ ID NO: 2264 - DNA, 10 bp, Artificial Sequence
  synthetic Reed-Solomon code for 8+2 base, 1 base error, 2 nocall correction
tacactagcc

SEQ ID NO: 2265 - DNA, 10 bp, Artificial Sequence
  synthetic Reed-Solomon code for 8+2 base, 1 base error, 2 nocall correction
gccactagtc

SEQ ID NO: 2266 - DNA, 10 bp, Artificial Sequence
  synthetic Reed-Solomon code for 8+2 base, 1 base error, 2 nocall correction
gtcactagga

SEQ ID NO: 2267 - DNA, 10 bp, Artificial Sequence
  synthetic Reed-Solomon code for 8+2 base, 1 base error, 2 nocall correction
ccgactagtg

SEQ ID NO: 2268 - DNA, 10 bp, Artificial Sequence
  synthetic Reed-Solomon code for 8+2 base, 1 base error, 2 nocall correction
catactagct

SEQ ID NO: 2269 - DNA, 10 bp, Artificial Sequence
  synthetic Reed-Solomon code for 8+2 base, 1 base error, 2 nocall correction
tcacctagac

SEQ ID NO: 2270 - DNA, 10 bp, Artificial Sequence
  synthetic Reed-Solomon code for 8+2 base, 1 base error, 2 nocall correction
ccccctagcg

SEQ ID NO: 2271 - DNA, 10 bp, Artificial Sequence
  synthetic Reed-Solomon code for 8+2 base, 1 base error, 2 nocall correction
tagcctagtc

SEQ ID NO: 2272 - DNA, 10 bp, Artificial Sequence
  synthetic Reed-Solomon code for 8+2 base, 1 base error, 2 nocall correction
gcgcctagcc

SEQ ID NO: 2273 - DNA, 10 bp, Artificial Sequence
  synthetic Reed-Solomon code for 8+2 base, 1 base error, 2 nocall correction
gtagctaggt

SEQ ID NO: 2274 - DNA, 10 bp, Artificial Sequence
  synthetic Reed-Solomon code for 8+2 base, 1 base error, 2 nocall correction
ggcgctaggc

SEQ ID NO: 2275 - DNA, 10 bp, Artificial Sequence
  synthetic Reed-Solomon code for 8+2 base, 1 base error, 2 nocall correction
cgggctaggg

SEQ ID NO: 2276 - DNA, 10 bp, Artificial Sequence
  synthetic Reed-Solomon code for 8+2 base, 1 base error, 2 nocall correction
aatgctagcc

SEQ ID NO: 2277 - DNA, 10 bp, Artificial Sequence
  synthetic Reed-Solomon code for 8+2 base, 1 base error, 2 nocall correction
tgatctagtg

SEQ ID NO: 2278 - DNA, 10 bp, Artificial Sequence
  synthetic Reed-Solomon code for 8+2 base, 1 base error, 2 nocall correction
ctttctagtg

SEQ ID NO: 2279 - DNA, 10 bp, Artificial Sequence
  synthetic Reed-Solomon code for 8+2 base, 1 base error, 2 nocall correction
acgagtagct

SEQ ID NO: 2280 - DNA, 10 bp, Artificial Sequence
  synthetic Reed-Solomon code for 8+2 base, 1 base error, 2 nocall correction
aatagtagtg

SEQ ID NO: 2281 - DNA, 10 bp, Artificial Sequence
  synthetic Reed-Solomon code for 8+2 base, 1 base error, 2 nocall correction
gctagtagaa

SEQ ID NO: 2282 - DNA, 10 bp, Artificial Sequence
  synthetic Reed-Solomon code for 8+2 base, 1 base error, 2 nocall correction
agacgtagga

SEQ ID NO: 2283 - DNA, 10 bp, Artificial Sequence
  synthetic Reed-Solomon code for 8+2 base, 1 base error, 2 nocall correction
ctacgtaggt

SEQ ID NO: 2284 - DNA, 10 bp, Artificial Sequence
  synthetic Reed-Solomon code for 8+2 base, 1 base error, 2 nocall correction
acccgtagtt

SEQ ID NO: 2285 - DNA, 10 bp, Artificial Sequence
  synthetic Reed-Solomon code for 8+2 base, 1 base error, 2 nocall correction
cgccgtaggc

SEQ ID NO: 2286 - DNA, 10 bp, Artificial Sequence
  synthetic Reed-Solomon code for 8+2 base, 1 base error, 2 nocall correction
gggcgtaggg

SEQ ID NO: 2287 - DNA, 10 bp, Artificial Sequence
  synthetic Reed-Solomon code for 8+2 base, 1 base error, 2 nocall correction
tgtcgtaggt

SEQ ID NO: 2288 - DNA, 10 bp, Artificial Sequence
  synthetic Reed-Solomon code for 8+2 base, 1 base error, 2 nocall correction
tacggtagtg

SEQ ID NO: 2289 - DNA, 10 bp, Artificial Sequence
  synthetic Reed-Solomon code for 8+2 base, 1 base error, 2 nocall correction
gccggtagcg

SEQ ID NO: 2290 - DNA, 10 bp, Artificial Sequence
  synthetic Reed-Solomon code for 8+2 base, 1 base error, 2 nocall correction
ccgggtagcc

SEQ ID NO: 2291 - DNA, 10 bp, Artificial Sequence
  synthetic Reed-Solomon code for 8+2 base, 1 base error, 2 nocall correction
gaatgtaggc

SEQ ID NO: 2292 - DNA, 10 bp, Artificial Sequence
  synthetic Reed-Solomon code for 8+2 base, 1 base error, 2 nocall correction
atatgtagag

SEQ ID NO: 2293 - DNA, 10 bp, Artificial Sequence
  synthetic Reed-Solomon code for 8+2 base, 1 base error, 2 nocall correction
ttatgtagca

SEQ ID NO: 2294 - DNA, 10 bp, Artificial Sequence
  synthetic Reed-Solomon code for 8+2 base, 1 base error, 2 nocall correction
gtgtgtagaa

SEQ ID NO: 2295 - DNA, 10 bp, Artificial Sequence
  synthetic Reed-Solomon code for 8+2 base, 1 base error, 2 nocall correction
cgttgtagca

SEQ ID NO: 2296 - DNA, 10 bp, Artificial Sequence
  synthetic Reed-Solomon code for 8+2 base, 1 base error, 2 nocall correction
atttgtagct

SEQ ID NO: 2297 - DNA, 10 bp, Artificial Sequence
  synthetic Reed-Solomon code for 8+2 base, 1 base error, 2 nocall correction
ggaattagcc

SEQ ID NO: 2298 - DNA, 10 bp, Artificial Sequence
  synthetic Reed-Solomon code for 8+2 base, 1 base error, 2 nocall correction
gtcattagct

SEQ ID NO: 2299 - DNA, 10 bp, Artificial Sequence
  synthetic Reed-Solomon code for 8+2 base, 1 base error, 2 nocall correction
tggattagac

SEQ ID NO: 2300 - DNA, 10 bp, Artificial Sequence
  synthetic Reed-Solomon code for 8+2 base, 1 base error, 2 nocall correction
catattagga

SEQ ID NO: 2301 - DNA, 10 bp, Artificial Sequence
  synthetic Reed-Solomon code for 8+2 base, 1 base error, 2 nocall correction
cgacttagtg

SEQ ID NO: 2302 - DNA, 10 bp, Artificial Sequence
  synthetic Reed-Solomon code for 8+2 base, 1 base error, 2 nocall correction
gtgcttagtt

SEQ ID NO: 2303 - DNA, 10 bp, Artificial Sequence
  synthetic Reed-Solomon code for 8+2 base, 1 base error, 2 nocall correction
tttcttagtg

SEQ ID NO: 2304 - DNA, 10 bp, Artificial Sequence
  synthetic Reed-Solomon code for 8+2 base, 1 base error, 2 nocall correction
taagttaggc

SEQ ID NO: 2305 - DNA, 10 bp, Artificial Sequence
  synthetic Reed-Solomon code for 8+2 base, 1 base error, 2 nocall correction
gtagttagca

SEQ ID NO: 2306 - DNA, 10 bp, Artificial Sequence
  synthetic Reed-Solomon code for 8+2 base, 1 base error, 2 nocall correction
atggttagcg

SEQ ID NO: 2307 - DNA, 10 bp, Artificial Sequence
  synthetic Reed-Solomon code for 8+2 base, 1 base error, 2 nocall correction
ttggttagaa

SEQ ID NO: 2308 - DNA, 10 bp, Artificial Sequence
  synthetic Reed-Solomon code for 8+2 base, 1 base error, 2 nocall correction
ccatttagac

SEQ ID NO: 2309 - DNA, 10 bp, Artificial Sequence
  synthetic Reed-Solomon code for 8+2 base, 1 base error, 2 nocall correction
gactttagtg

SEQ ID NO: 2310 - DNA, 10 bp, Artificial Sequence
  synthetic Reed-Solomon code for 8+2 base, 1 base error, 2 nocall correction
acctttagaa

SEQ ID NO: 2311 - DNA, 10 bp, Artificial Sequence
  synthetic Reed-Solomon code for 8+2 base, 1 base error, 2 nocall correction
tcctttagcg

SEQ ID NO: 2312 - DNA, 10 bp, Artificial Sequence
  synthetic Reed-Solomon code for 8+2 base, 1 base error, 2 nocall correction
cagtttagtc

SEQ ID NO: 2313 - DNA, 10 bp, Artificial Sequence
  synthetic Reed-Solomon code for 8+2 base, 1 base error, 2 nocall correction
cgaaaacggg

SEQ ID NO: 2314 - DNA, 10 bp, Artificial Sequence
  synthetic Reed-Solomon code for 8+2 base, 1 base error, 2 nocall correction
gtgaaacggt

SEQ ID NO: 2315 - DNA, 10 bp, Artificial Sequence
  synthetic Reed-Solomon code for 8+2 base, 1 base error, 2 nocall correction
tttaaacggg

SEQ ID NO: 2316 - DNA, 10 bp, Artificial Sequence
  synthetic Reed-Solomon code for 8+2 base, 1 base error, 2 nocall correction
catcaacgta

SEQ ID NO: 2317 - DNA, 10 bp, Artificial Sequence
  synthetic Reed-Solomon code for 8+2 base, 1 base error, 2 nocall correction
ccagaacgtg

SEQ ID NO: 2318 - DNA, 10 bp, Artificial Sequence
  synthetic Reed-Solomon code for 8+2 base, 1 base error, 2 nocall correction
gacgaacgac

SEQ ID NO: 2319 - DNA, 10 bp, Artificial Sequence
  synthetic Reed-Solomon code for 8+2 base, 1 base error, 2 nocall correction
atcgaacggg

SEQ ID NO: 2320 - DNA, 10 bp, Artificial Sequence
  synthetic Reed-Solomon code for 8+2 base, 1 base error, 2 nocall correction
caggaacgag

SEQ ID NO: 2321 - DNA, 10 bp, Artificial Sequence
  synthetic Reed-Solomon code for 8+2 base, 1 base error, 2 nocall correction
tcgtaacggg

SEQ ID NO: 2322 - DNA, 10 bp, Artificial Sequence
  synthetic Reed-Solomon code for 8+2 base, 1 base error, 2 nocall correction
gcttaacggt

SEQ ID NO: 2323 - DNA, 10 bp, Artificial Sequence
  synthetic Reed-Solomon code for 8+2 base, 1 base error, 2 nocall correction
taaacacgtt

SEQ ID NO: 2324 - DNA, 10 bp, Artificial Sequence
  synthetic Reed-Solomon code for 8+2 base, 1 base error, 2 nocall correction
gcaacacgct

SEQ ID NO: 2325 - DNA, 10 bp, Artificial Sequence
  synthetic Reed-Solomon code for 8+2 base, 1 base error, 2 nocall correction
tcgacacgat

SEQ ID NO: 2326 - DNA, 10 bp, Artificial Sequence
  synthetic Reed-Solomon code for 8+2 base, 1 base error, 2 nocall correction
aatacacgta

SEQ ID NO: 2327 - DNA, 10 bp, Artificial Sequence
  synthetic Reed-Solomon code for 8+2 base, 1 base error, 2 nocall correction
gctacacgag

SEQ ID NO: 2328 - DNA, 10 bp, Artificial Sequence
  synthetic Reed-Solomon code for 8+2 base, 1 base error, 2 nocall correction
agaccacggg

SEQ ID NO: 2329 - DNA, 10 bp, Artificial Sequence
  synthetic Reed-Solomon code for 8+2 base, 1 base error, 2 nocall correction
gacccacgat

SEQ ID NO: 2330 - DNA, 10 bp, Artificial Sequence
  synthetic Reed-Solomon code for 8+2 base, 1 base error, 2 nocall correction
gggccacgga

SEQ ID NO: 2331 - DNA, 10 bp, Artificial Sequence
  synthetic Reed-Solomon code for 8+2 base, 1 base error, 2 nocall correction
tacgcacgta

SEQ ID NO: 2332 - DNA, 10 bp, Artificial Sequence
  synthetic Reed-Solomon code for 8+2 base, 1 base error, 2 nocall correction
gccgcacgca

SEQ ID NO: 2333 - DNA, 10 bp, Artificial Sequence
  synthetic Reed-Solomon code for 8+2 base, 1 base error, 2 nocall correction
cgatcacgat

SEQ ID NO: 2334 - DNA, 10 bp, Artificial Sequence
  synthetic Reed-Solomon code for 8+2 base, 1 base error, 2 nocall correction
atatcacgaa

SEQ ID NO: 2335 - DNA, 10 bp, Artificial Sequence
  synthetic Reed-Solomon code for 8+2 base, 1 base error, 2 nocall correction
ttatcacgcg

SEQ ID NO: 2336 - DNA, 10 bp, Artificial Sequence
  synthetic Reed-Solomon code for 8+2 base, 1 base error, 2 nocall correction
ctctcacgac

SEQ ID NO: 2337 - DNA, 10 bp, Artificial Sequence
  synthetic Reed-Solomon code for 8+2 base, 1 base error, 2 nocall correction
aagtcacggc

SEQ ID NO: 2338 - DNA, 10 bp, Artificial Sequence
  synthetic Reed-Solomon code for 8+2 base, 1 base error, 2 nocall correction
gtgtcacgag

SEQ ID NO: 2339 - DNA, 10 bp, Artificial Sequence
  synthetic Reed-Solomon code for 8+2 base, 1 base error, 2 nocall correction
cgttcacgcg

SEQ ID NO: 2340 - DNA, 10 bp, Artificial Sequence
  synthetic Reed-Solomon code for 8+2 base, 1 base error, 2 nocall correction
ttttcacgat

SEQ ID NO: 2341 - DNA, 10 bp, Artificial Sequence
  synthetic Reed-Solomon code for 8+2 base, 1 base error, 2 nocall correction
caaagacgaa

SEQ ID NO: 2342 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
aacagacgac

SEQ ID NO: 2343 - DNA, 10 bp, Artificial Sequence
  synthetic Reed-Solomon code for 8+2 base, 1 base error, 2 nocall correction
gtcagacggg

SEQ ID NO: 2344 - DNA, 10 bp, Artificial Sequence
  synthetic Reed-Solomon code for 8+2 base, 1 base error, 2 nocall correction
ccgagacgta

SEQ ID NO: 2345 - DNA, 10 bp, Artificial Sequence
  synthetic Reed-Solomon code for 8+2 base, 1 base error, 2 nocall correction
ctgagacggc

SEQ ID NO: 2346 - DNA, 10 bp, Artificial Sequence
  synthetic Reed-Solomon code for 8+2 base, 1 base error, 2 nocall correction
acacgacgcc

SEQ ID NO: 2347 - DNA, 10 bp, Artificial Sequence
  synthetic Reed-Solomon code for 8+2 base, 1 base error, 2 nocall correction
ccccgacgca

SEQ ID NO: 2348 - DNA, 10 bp, Artificial Sequence
  synthetic Reed-Solomon code for 8+2 base, 1 base error, 2 nocall correction
cacggacgat

SEQ ID NO: 2349 - DNA, 10 bp, Artificial Sequence
  synthetic Reed-Solomon code for 8+2 base, 1 base error, 2 nocall correction
cggggacgga

SEQ ID NO: 2350 - DNA, 10 bp, Artificial Sequence
  synthetic Reed-Solomon code for 8+2 base, 1 base error, 2 nocall correction
atgggacggt

SEQ ID NO: 2351 - DNA, 10 bp, Artificial Sequence
  synthetic Reed-Solomon code for 8+2 base, 1 base error, 2 nocall correction
tatggacgac

SEQ ID NO: 2352 - DNA, 10 bp, Artificial Sequence
  synthetic Reed-Solomon code for 8+2 base, 1 base error, 2 nocall correction
tgatgacgta

SEQ ID NO: 2353 - DNA, 10 bp, Artificial Sequence
  synthetic Reed-Solomon code for 8+2 base, 1 base error, 2 nocall correction
tcctgacggt

SEQ ID NO: 2354 - DNA, 10 bp, Artificial Sequence
  synthetic Reed-Solomon code for 8+2 base, 1 base error, 2 nocall correction
ccttgacggc

SEQ ID NO: 2355 - DNA, 10 bp, Artificial Sequence
  synthetic Reed-Solomon code for 8+2 base, 1 base error, 2 nocall correction
agttgacgtt

SEQ ID NO: 2356 - DNA, 10 bp, Artificial Sequence
  synthetic Reed-Solomon code for 8+2 base, 1 base error, 2 nocall correction
ctttgacgta

SEQ ID NO: 2357 - DNA, 10 bp, Artificial Sequence
  synthetic Reed-Solomon code for 8+2 base, 1 base error, 2 nocall correction
gcaatacgga

SEQ ID NO: 2358 - DNA, 10 bp, Artificial Sequence
  synthetic Reed-Solomon code for 8+2 base, 1 base error, 2 nocall correction
gtaatacgtc

SEQ ID NO: 2359 - DNA, 10 bp, Artificial Sequence
  synthetic Reed-Solomon code for 8+2 base, 1 base error, 2 nocall correction
ggcatacgtt

SEQ ID NO: 2360 - DNA, 10 bp, Artificial Sequence
  synthetic Reed-Solomon code for 8+2 base, 1 base error, 2 nocall correction
acgatacggg

SEQ ID NO: 2361 - DNA, 10 bp, Artificial Sequence
  synthetic Reed-Solomon code for 8+2 base, 1 base error, 2 nocall correction
tgactacgat

SEQ ID NO: 2362 - DNA, 10 bp, Artificial Sequence
  synthetic Reed-Solomon code for 8+2 base, 1 base error, 2 nocall correction
ctactacgcg

SEQ ID NO: 2363 - DNA, 10 bp, Artificial Sequence
  synthetic Reed-Solomon code for 8+2 base, 1 base error, 2 nocall correction
ttcctacgac

SEQ ID NO: 2364 - DNA, 10 bp, Artificial Sequence
  synthetic Reed-Solomon code for 8+2 base, 1 base error, 2 nocall correction
gggctacgct

SEQ ID NO: 2365 - DNA, 10 bp, Artificial Sequence
  synthetic Reed-Solomon code for 8+2 base, 1 base error, 2 nocall correction
agtctacgaa

SEQ ID NO: 2366 - DNA, 10 bp, Artificial Sequence
  synthetic Reed-Solomon code for 8+2 base, 1 base error, 2 nocall correction
tgtctacgcg

SEQ ID NO: 2367 - DNA, 10 bp, Artificial Sequence
  synthetic Reed-Solomon code for 8+2 base, 1 base error, 2 nocall correction
cttctacgat

SEQ ID NO: 2368 - DNA, 10 bp, Artificial Sequence
  synthetic Reed-Solomon code for 8+2 base, 1 base error, 2 nocall correction
ggagtacgta

SEQ ID NO: 2369 - DNA, 10 bp, Artificial Sequence
  synthetic Reed-Solomon code for 8+2 base, 1 base error, 2 nocall correction
gccgtacggt

SEQ ID NO: 2370 - DNA, 10 bp, Artificial Sequence
  synthetic Reed-Solomon code for 8+2 base, 1 base error, 2 nocall correction
agggtacgtg

SEQ ID NO: 2371 - DNA, 10 bp, Artificial Sequence
  synthetic Reed-Solomon code for 8+2 base, 1 base error, 2 nocall correction
gatttacgac

SEQ ID NO: 2372 - DNA, 10 bp, Artificial Sequence
  synthetic Reed-Solomon code for 8+2 base, 1 base error, 2 nocall correction
attttacggg

SEQ ID NO: 2373 - DNA, 10 bp, Artificial Sequence
  synthetic Reed-Solomon code for 8+2 base, 1 base error, 2 nocall correction
gaaaaccgct

SEQ ID NO: 2374 - DNA, 10 bp, Artificial Sequence
  synthetic Reed-Solomon code for 8+2 base, 1 base error, 2 nocall correction
tcaaaccgtt

SEQ ID NO: 2375 - DNA, 10 bp, Artificial Sequence
  synthetic Reed-Solomon code for 8+2 base, 1 base error, 2 nocall correction
tgcaaccgga

SEQ ID NO: 2376 - DNA, 10 bp, Artificial Sequence
  synthetic Reed-Solomon code for 8+2 base, 1 base error, 2 nocall correction
tagaaccgat

SEQ ID NO: 2377 - DNA, 10 bp, Artificial Sequence
  synthetic Reed-Solomon code for 8+2 base, 1 base error, 2 nocall correction
gataaccgag

SEQ ID NO: 2378 - DNA, 10 bp, Artificial Sequence
  synthetic Reed-Solomon code for 8+2 base, 1 base error, 2 nocall correction
actaaccgta

SEQ ID NO: 2379 - DNA, 10 bp, Artificial Sequence
  synthetic Reed-Solomon code for 8+2 base, 1 base error, 2 nocall correction
attaaccggc

SEQ ID NO: 2380 - DNA, 10 bp, Artificial Sequence
  synthetic Reed-Solomon code for 8+2 base, 1 base error, 2 nocall correction
gcccaccgat

SEQ ID NO: 2381 - DNA, 10 bp, Artificial Sequence
  synthetic Reed-Solomon code for 8+2 base, 1 base error, 2 nocall correction
tgagaccggt

SEQ ID NO: 2382 - DNA, 10 bp, Artificial Sequence
  synthetic Reed-Solomon code for 8+2 base, 1 base error, 2 nocall correction
gacgaccgca

SEQ ID NO: 2383 - DNA, 10 bp, Artificial Sequence
  synthetic Reed-Solomon code for 8+2 base, 1 base error, 2 nocall correction
tccgaccgta

SEQ ID NO: 2384 - DNA, 10 bp, Artificial Sequence
  synthetic Reed-Solomon code for 8+2 base, 1 base error, 2 nocall correction
ttcgaccggc

SEQ ID NO: 2385 - DNA, 10 bp, Artificial Sequence
  synthetic Reed-Solomon code for 8+2 base, 1 base error, 2 nocall correction
agtgaccgga

SEQ ID NO: 2386 - DNA, 10 bp, Artificial Sequence
  synthetic Reed-Solomon code for 8+2 base, 1 base error, 2 nocall correction
cttgaccggt

SEQ ID NO: 2387 - DNA, 10 bp, Artificial Sequence
  synthetic Reed-Solomon code for 8+2 base, 1 base error, 2 nocall correction
gtataccgtg

SEQ ID NO: 2388 - DNA, 10 bp, Artificial Sequence
  synthetic Reed-Solomon code for 8+2 base, 1 base error, 2 nocall correction
acgtaccggc

SEQ ID NO: 2389 - DNA, 10 bp, Artificial Sequence
  synthetic Reed-Solomon code for 8+2 base, 1 base error, 2 nocall correction
cggtaccgtt

SEQ ID NO: 2390 - DNA, 10 bp, Artificial Sequence
  synthetic Reed-Solomon code for 8+2 base, 1 base error, 2 nocall correction
atgtaccgta

SEQ ID NO: 2391 - DNA, 10 bp, Artificial Sequence
  synthetic Reed-Solomon code for 8+2 base, 1 base error, 2 nocall correction
tgaccccggc

SEQ ID NO: 2392 - DNA, 10 bp, Artificial Sequence
  synthetic Reed-Solomon code for 8+2 base, 1 base error, 2 nocall correction
ttcccccggt

SEQ ID NO: 2393 - DNA, 10 bp, Artificial Sequence
  synthetic Reed-Solomon code for 8+2 base, 1 base error, 2 nocall correction
cctccccgta

SEQ ID NO: 2394 - DNA, 10 bp, Artificial Sequence
  synthetic Reed-Solomon code for 8+2 base, 1 base error, 2 nocall correction
cttccccggc

SEQ ID NO: 2395 - DNA, 10 bp, Artificial Sequence
  synthetic Reed-Solomon code for 8+2 base, 1 base error, 2 nocall correction
caagcccgtg

SEQ ID NO: 2396 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
gccgcccgac

SEQ ID NO: 2397 - DNA, 10 bp, Artificial Sequence
  synthetic Reed-Solomon code for 8+2 base, 1 base error, 2 nocall correction
ccggcccgag

SEQ ID NO: 2398 - DNA, 10 bp, Artificial Sequence
  synthetic Reed-Solomon code for 8+2 base, 1 base error, 2 nocall correction
atatcccgcc

SEQ ID NO: 2399 - DNA, 10 bp, Artificial Sequence
  synthetic Reed-Solomon code for 8+2 base, 1 base error, 2 nocall correction
agctcccgct

SEQ ID NO: 2400 - DNA, 10 bp, Artificial Sequence
  synthetic Reed-Solomon code for 8+2 base, 1 base error, 2 nocall correction
ctctcccgca

SEQ ID NO: 2401 - DNA, 10 bp, Artificial Sequence
  synthetic Reed-Solomon code for 8+2 base, 1 base error, 2 nocall correction
tagtcccggg

SEQ ID NO: 2402 - DNA, 10 bp, Artificial Sequence
  synthetic Reed-Solomon code for 8+2 base, 1 base error, 2 nocall correction
gattcccggt

SEQ ID NO: 2403 - DNA, 10 bp, Artificial Sequence
  synthetic Reed-Solomon code for 8+2 base, 1 base error, 2 nocall correction
caaagccgcc

SEQ ID NO: 2404 - DNA, 10 bp, Artificial Sequence
  synthetic Reed-Solomon code for 8+2 base, 1 base error, 2 nocall correction
aacagccgca

SEQ ID NO: 2405 - DNA, 10 bp, Artificial Sequence
  synthetic Reed-Solomon code for 8+2 base, 1 base error, 2 nocall correction
tacagccgag

SEQ ID NO: 2406 - DNA, 10 bp, Artificial Sequence
  synthetic Reed-Solomon code for 8+2 base, 1 base error, 2 nocall correction
ggtagccgga

SEQ ID NO: 2407 - DNA, 10 bp, Artificial Sequence
  synthetic Reed-Solomon code for 8+2 base, 1 base error, 2 nocall correction
gaacgccgtg

SEQ ID NO: 2408 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
acacgccgaa

SEQ ID NO: 2409 - DNA, 10 bp, Artificial Sequence
  synthetic Reed-Solomon code for 8+2 base, 1 base error, 2 nocall correction
tcacgccgcg

SEQ ID NO: 2410 - DNA, 10 bp, Artificial Sequence
  synthetic Reed-Solomon code for 8+2 base, 1 base error, 2 nocall correction
ccccgccgac

SEQ ID NO: 2411 - DNA, 10 bp, Artificial Sequence
  synthetic Reed-Solomon code for 8+2 base, 1 base error, 2 nocall correction
aagcgccgta

SEQ ID NO: 2412 - DNA, 10 bp, Artificial Sequence
  synthetic Reed-Solomon code for 8+2 base, 1 base error, 2 nocall correction
gcgcgccgag

SEQ ID NO: 2413 - DNA, 10 bp, Artificial Sequence
  synthetic Reed-Solomon code for 8+2 base, 1 base error, 2 nocall correction
tctcgccgat

SEQ ID NO: 2414 - DNA, 10 bp, Artificial Sequence
  synthetic Reed-Solomon code for 8+2 base, 1 base error, 2 nocall correction
aaaggccgct

SEQ ID NO: 2415 - DNA, 10 bp, Artificial Sequence
  synthetic Reed-Solomon code for 8+2 base, 1 base error, 2 nocall correction
aatggccgag

SEQ ID NO: 2416 - DNA, 10 bp, Artificial Sequence
  synthetic Reed-Solomon code for 8+2 base, 1 base error, 2 nocall correction
tatggccgca

SEQ ID NO: 2417 - DNA, 10 bp, Artificial Sequence
  synthetic Reed-Solomon code for 8+2 base, 1 base error, 2 nocall correction
gctggccgta

SEQ ID NO: 2418 - DNA, 10 bp, Artificial Sequence
  synthetic Reed-Solomon code for 8+2 base, 1 base error, 2 nocall correction
gttggccggc

SEQ ID NO: 2419 - DNA, 10 bp, Artificial Sequence
  synthetic Reed-Solomon code for 8+2 base, 1 base error, 2 nocall correction
cgctgccgtg

SEQ ID NO: 2420 - DNA, 10 bp, Artificial Sequence
  synthetic Reed-Solomon code for 8+2 base, 1 base error, 2 nocall correction
gggtgccgtc

SEQ ID NO: 2421 - DNA, 10 bp, Artificial Sequence
  synthetic Reed-Solomon code for 8+2 base, 1 base error, 2 nocall correction
tcgatccggc

SEQ ID NO: 2422 - DNA, 10 bp, Artificial Sequence
  synthetic Reed-Solomon code for 8+2 base, 1 base error, 2 nocall correction
ttgatccgta

SEQ ID NO: 2423 - DNA, 10 bp, Artificial Sequence
  synthetic Reed-Solomon code for 8+2 base, 1 base error, 2 nocall correction
gacctccggc

SEQ ID NO: 2424 - DNA, 10 bp, Artificial Sequence
  synthetic Reed-Solomon code for 8+2 base, 1 base error, 2 nocall correction
atcctccgag

SEQ ID NO: 2425 - DNA, 10 bp, Artificial Sequence
  synthetic Reed-Solomon code for 8+2 base, 1 base error, 2 nocall correction
ttcctccgca

SEQ ID NO: 2426 - DNA, 10 bp, Artificial Sequence
  synthetic Reed-Solomon code for 8+2 base, 1 base error, 2 nocall correction
cagctccggg

SEQ ID NO: 2427 - DNA, 10 bp, Artificial Sequence
  synthetic Reed-Solomon code for 8+2 base, 1 base error, 2 nocall correction
agtctccgcc

SEQ ID NO: 2428 - DNA, 10 bp, Artificial Sequence
  synthetic Reed-Solomon code for 8+2 base, 1 base error, 2 nocall correction
tgggtccgtc

SEQ ID NO: 2429 - DNA, 10 bp, Artificial Sequence
  synthetic Reed-Solomon code for 8+2 base, 1 base error, 2 nocall correction
acattccgtt

SEQ ID NO: 2430 - DNA, 10 bp, Artificial Sequence
  synthetic Reed-Solomon code for 8+2 base, 1 base error, 2 nocall correction
cgattccggc

SEQ ID NO: 2431 - DNA, 10 bp, Artificial Sequence
  synthetic Reed-Solomon code for 8+2 base, 1 base error, 2 nocall correction
agcttccgga

SEQ ID NO: 2432 - DNA, 10 bp, Artificial Sequence
  synthetic Reed-Solomon code for 8+2 base, 1 base error, 2 nocall correction
ctcttccggt

SEQ ID NO: 2433 - DNA, 10 bp, Artificial Sequence
  synthetic Reed-Solomon code for 8+2 base, 1 base error, 2 nocall correction
aagttccgat

SEQ ID NO: 2434 - DNA, 10 bp, Artificial Sequence
  synthetic Reed-Solomon code for 8+2 base, 1 base error, 2 nocall correction
gatttccgca

SEQ ID NO: 2435 - DNA, 10 bp, Artificial Sequence
  synthetic Reed-Solomon code for 8+2 base, 1 base error, 2 nocall correction
tctttccgta

SEQ ID NO: 2436 - DNA, 10 bp, Artificial Sequence
  synthetic Reed-Solomon code for 8+2 base, 1 base error, 2 nocall correction
tttttccggc

SEQ ID NO: 2437 - DNA, 10 bp, Artificial Sequence
  synthetic Reed-Solomon code for 8+2 base, 1 base error, 2 nocall correction
cgaaagcgaa

SEQ ID NO: 2438 - DNA, 10 bp, Artificial Sequence
  synthetic Reed-Solomon code for 8+2 base, 1 base error, 2 nocall correction
ataaagcgat

SEQ ID NO: 2439 - DNA, 10 bp, Artificial Sequence
  synthetic Reed-Solomon code for 8+2 base, 1 base error, 2 nocall correction
agcaagcgac

SEQ ID NO: 2440 - DNA, 10 bp, Artificial Sequence
  synthetic Reed-Solomon code for 8+2 base, 1 base error, 2 nocall correction
attaagcgcg

SEQ ID NO: 2441 - DNA, 10 bp, Artificial Sequence
  synthetic Reed-Solomon code for 8+2 base, 1 base error, 2 nocall correction
tttaagcgaa

SEQ ID NO: 2442 - DNA, 10 bp, Artificial Sequence
  synthetic Reed-Solomon code for 8+2 base, 1 base error, 2 nocall correction
ctagagcgac

SEQ ID NO: 2443 - DNA, 10 bp, Artificial Sequence
  synthetic Reed-Solomon code for 8+2 base, 1 base error, 2 nocall correction
cgcgagcgat

SEQ ID NO: 2444 - DNA, 10 bp, Artificial Sequence
  synthetic Reed-Solomon code for 8+2 base, 1 base error, 2 nocall correction
atcgagcgaa

SEQ ID NO: 2445 - DNA, 10 bp, Artificial Sequence
  synthetic Reed-Solomon code for 8+2 base, 1 base error, 2 nocall correction
ttcgagcgcg

SEQ ID NO: 2446 - DNA, 10 bp, Artificial Sequence
  synthetic Reed-Solomon code for 8+2 base, 1 base error, 2 nocall correction
caggagcgga

SEQ ID NO: 2447 - DNA, 10 bp, Artificial Sequence
  synthetic Reed-Solomon code for 8+2 base, 1 base error, 2 nocall correction
tgtgagcgac

SEQ ID NO: 2448 - DNA, 10 bp, Artificial Sequence
  synthetic Reed-Solomon code for 8+2 base, 1 base error, 2 nocall correction
taatagcgta

SEQ ID NO: 2449 - DNA, 10 bp, Artificial Sequence
  synthetic Reed-Solomon code for 8+2 base, 1 base error, 2 nocall correction
gcatagcgca

SEQ ID NO: 2450 - DNA, 10 bp, Artificial Sequence
  synthetic Reed-Solomon code for 8+2 base, 1 base error, 2 nocall correction
acgtagcgcg

SEQ ID NO: 2451 - DNA, 10 bp, Artificial Sequence
  synthetic Reed-Solomon code for 8+2 base, 1 base error, 2 nocall correction
tcgtagcgaa

SEQ ID NO: 2452 - DNA, 10 bp, Artificial Sequence
  synthetic Reed-Solomon code for 8+2 base, 1 base error, 2 nocall correction
aattagcgtt

SEQ ID NO: 2453 - DNA, 10 bp, Artificial Sequence
  synthetic Reed-Solomon code for 8+2 base, 1 base error, 2 nocall correction
gctacgcgga

SEQ ID NO: 2454 - DNA, 10 bp, Artificial Sequence
  synthetic Reed-Solomon code for 8+2 base, 1 base error, 2 nocall correction
gttacgcgtc

SEQ ID NO: 2455 - DNA, 10 bp, Artificial Sequence
  synthetic Reed-Solomon code for 8+2 base, 1 base error, 2 nocall correction
agaccgcgaa

SEQ ID NO: 2456 - DNA, 10 bp, Artificial Sequence
  synthetic Reed-Solomon code for 8+2 base, 1 base error, 2 nocall correction
tgaccgcgcg

SEQ ID NO: 2457 - DNA, 10 bp, Artificial Sequence
  synthetic Reed-Solomon code for 8+2 base, 1 base error, 2 nocall correction
ctaccgcgat

SEQ ID NO: 2458 - DNA, 10 bp, Artificial Sequence
  synthetic Reed-Solomon code for 8+2 base, 1 base error, 2 nocall correction
cgcccgcgac

SEQ ID NO: 2459 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
gggccgcgag

SEQ ID NO: 2460 - DNA, 10 bp, Artificial Sequence
  synthetic Reed-Solomon code for 8+2 base, 1 base error, 2 nocall correction
tgtccgcgat

SEQ ID NO: 2461 - DNA, 10 bp, Artificial Sequence
  synthetic Reed-Solomon code for 8+2 base, 1 base error, 2 nocall correction
cttccgcgcg

SEQ ID NO: 2462 - DNA, 10 bp, Artificial Sequence
  synthetic Reed-Solomon code for 8+2 base, 1 base error, 2 nocall correction
ggtgcgcgta

SEQ ID NO: 2463 - DNA, 10 bp, Artificial Sequence
  synthetic Reed-Solomon code for 8+2 base, 1 base error, 2 nocall correction
gaatcgcgac

SEQ ID NO: 2464 - DNA, 10 bp, Artificial Sequence
  synthetic Reed-Solomon code for 8+2 base, 1 base error, 2 nocall correction
atatcgcggg

SEQ ID NO: 2465 - DNA, 10 bp, Artificial Sequence
  synthetic Reed-Solomon code for 8+2 base, 1 base error, 2 nocall correction
ccctcgcgtg

SEQ ID NO: 2466 - DNA, 10 bp, Artificial Sequence
  synthetic Reed-Solomon code for 8+2 base, 1 base error, 2 nocall correction
tagtcgcgcc

SEQ ID NO: 2467 - DNA, 10 bp, Artificial Sequence
  synthetic Reed-Solomon code for 8+2 base, 1 base error, 2 nocall correction
gcgtcgcgtc

SEQ ID NO: 2468 - DNA, 10 bp, Artificial Sequence
  synthetic Reed-Solomon code for 8+2 base, 1 base error, 2 nocall correction
gtgtcgcgga

SEQ ID NO: 2469 - DNA, 10 bp, Artificial Sequence
  synthetic Reed-Solomon code for 8+2 base, 1 base error, 2 nocall correction
caaaggcggg

SEQ ID NO: 2470 - DNA, 10 bp, Artificial Sequence
  synthetic Reed-Solomon code for 8+2 base, 1 base error, 2 nocall correction
gtcaggcgaa

SEQ ID NO: 2471 - DNA, 10 bp, Artificial Sequence
  synthetic Reed-Solomon code for 8+2 base, 1 base error, 2 nocall correction
tcacggcggc

SEQ ID NO: 2472 - DNA, 10 bp, Artificial Sequence
  synthetic Reed-Solomon code for 8+2 base, 1 base error, 2 nocall correction
ttacggcgta

SEQ ID NO: 2473 - DNA, 10 bp, Artificial Sequence
  synthetic Reed-Solomon code for 8+2 base, 1 base error, 2 nocall correction
cgtcggcgta

SEQ ID NO: 2474 - DNA, 10 bp, Artificial Sequence
  synthetic Reed-Solomon code for 8+2 base, 1 base error, 2 nocall correction
attcggcgtt

SEQ ID NO: 2475 - DNA, 10 bp, Artificial Sequence
  synthetic Reed-Solomon code for 8+2 base, 1 base error, 2 nocall correction
gtagggcgat

SEQ ID NO: 2476 - DNA, 10 bp, Artificial Sequence
  synthetic Reed-Solomon code for 8+2 base, 1 base error, 2 nocall correction
ggcgggcgac

SEQ ID NO: 2477 - DNA, 10 bp, Artificial Sequence
  synthetic Reed-Solomon code for 8+2 base, 1 base error, 2 nocall correction
cgggggcgag

SEQ ID NO: 2478 - DNA, 10 bp, Artificial Sequence
  synthetic Reed-Solomon code for 8+2 base, 1 base error, 2 nocall correction
ttggggcgct

SEQ ID NO: 2479 - DNA, 10 bp, Artificial Sequence
  synthetic Reed-Solomon code for 8+2 base, 1 base error, 2 nocall correction
gttgggcgcg

SEQ ID NO: 2480 - DNA, 10 bp, Artificial Sequence
  synthetic Reed-Solomon code for 8+2 base, 1 base error, 2 nocall correction
acctggcgct

SEQ ID NO: 2481 - DNA, 10 bp, Artificial Sequence
  synthetic Reed-Solomon code for 8+2 base, 1 base error, 2 nocall correction
aaaatgcgta

SEQ ID NO: 2482 - DNA, 10 bp, Artificial Sequence
  synthetic Reed-Solomon code for 8+2 base, 1 base error, 2 nocall correction
gcaatgcgag

SEQ ID NO: 2483 - DNA, 10 bp, Artificial Sequence
  synthetic Reed-Solomon code for 8+2 base, 1 base error, 2 nocall correction
cacatgcgtc

SEQ ID NO: 2484 - DNA, 10 bp, Artificial Sequence
  synthetic Reed-Solomon code for 8+2 base, 1 base error, 2 nocall correction
gagatgcgtg

SEQ ID NO: 2485 - DNA, 10 bp, Artificial Sequence
  synthetic Reed-Solomon code for 8+2 base, 1 base error, 2 nocall correction
acgatgcgaa

SEQ ID NO: 2486 - DNA, 10 bp, Artificial Sequence
  synthetic Reed-Solomon code for 8+2 base, 1 base error, 2 nocall correction
tcgatgcgcg

SEQ ID NO: 2487 - DNA, 10 bp, Artificial Sequence
  synthetic Reed-Solomon code for 8+2 base, 1 base error, 2 nocall correction
tatatgcgtt

SEQ ID NO: 2488 - DNA, 10 bp, Artificial Sequence
  synthetic Reed-Solomon code for 8+2 base, 1 base error, 2 nocall correction
gctatgcgct

SEQ ID NO: 2489 - DNA, 10 bp, Artificial Sequence
  synthetic Reed-Solomon code for 8+2 base, 1 base error, 2 nocall correction
gacctgcgcg

SEQ ID NO: 2490 - DNA, 10 bp, Artificial Sequence
  synthetic Reed-Solomon code for 8+2 base, 1 base error, 2 nocall correction
tccctgcgtg

SEQ ID NO: 2491 - DNA, 10 bp, Artificial Sequence
  synthetic Reed-Solomon code for 8+2 base, 1 base error, 2 nocall correction
cagctgcgcc

SEQ ID NO: 2492 - DNA, 10 bp, Artificial Sequence
  synthetic Reed-Solomon code for 8+2 base, 1 base error, 2 nocall correction
agtctgcggg

SEQ ID NO: 2493 - DNA, 10 bp, Artificial Sequence
  synthetic Reed-Solomon code for 8+2 base, 1 base error, 2 nocall correction
aacgtgcgtt

SEQ ID NO: 2494 - DNA, 10 bp, Artificial Sequence
  synthetic Reed-Solomon code for 8+2 base, 1 base error, 2 nocall correction
cgattgcgcg

SEQ ID NO: 2495 - DNA, 10 bp, Artificial Sequence
  synthetic Reed-Solomon code for 8+2 base, 1 base error, 2 nocall correction
ttattgcgat

SEQ ID NO: 2496 - DNA, 10 bp, Artificial Sequence
  synthetic Reed-Solomon code for 8+2 base, 1 base error, 2 nocall correction
tgcttgcgac

SEQ ID NO: 2497 - DNA, 10 bp, Artificial Sequence
  synthetic Reed-Solomon code for 8+2 base, 1 base error, 2 nocall correction
gtgttgcgct

SEQ ID NO: 2498 - DNA, 10 bp, Artificial Sequence
  synthetic Reed-Solomon code for 8+2 base, 1 base error, 2 nocall correction
cgtttgcgat

SEQ ID NO: 2499 - DNA, 10 bp, Artificial Sequence
  synthetic Reed-Solomon code for 8+2 base, 1 base error, 2 nocall correction
attttgcgaa

SEQ ID NO: 2500 - DNA, 10 bp, Artificial Sequence
  synthetic Reed-Solomon code for 8+2 base, 1 base error, 2 nocall correction
tttttgcgcg

SEQ ID NO: 2501 - DNA, 10 bp, Artificial Sequence
  synthetic Reed-Solomon code for 8+2 base, 1 base error, 2 nocall correction
gaaaatcgtc

SEQ ID NO: 2502 - DNA, 10 bp, Artificial Sequence
  synthetic Reed-Solomon code for 8+2 base, 1 base error, 2 nocall correction
tcaaatcgcc

SEQ ID NO: 2503 - DNA, 10 bp, Artificial Sequence
  synthetic Reed-Solomon code for 8+2 base, 1 base error, 2 nocall correction
cccaatcgag

SEQ ID NO: 2504 - DNA, 10 bp, Artificial Sequence
  synthetic Reed-Solomon code for 8+2 base, 1 base error, 2 nocall correction
gcgaatcgac

SEQ ID NO: 2505 - DNA, 10 bp, Artificial Sequence
  synthetic Reed-Solomon code for 8+2 base, 1 base error, 2 nocall correction
caacatcgcg

SEQ ID NO: 2506 - DNA, 10 bp, Artificial Sequence
  synthetic Reed-Solomon code for 8+2 base, 1 base error, 2 nocall correction
taccatcgac

SEQ ID NO: 2507 - DNA, 10 bp, Artificial Sequence
  synthetic Reed-Solomon code for 8+2 base, 1 base error, 2 nocall correction
catcatcgat

SEQ ID NO: 2508 - DNA, 10 bp, Artificial Sequence
  synthetic Reed-Solomon code for 8+2 base, 1 base error, 2 nocall correction
cctgatcgca

SEQ ID NO: 2509 - DNA, 10 bp, Artificial Sequence
  synthetic Reed-Solomon code for 8+2 base, 1 base error, 2 nocall correction
ggctatcgcg

SEQ ID NO: 2510 - DNA, 10 bp, Artificial Sequence
  synthetic Reed-Solomon code for 8+2 base, 1 base error, 2 nocall correction
cggtatcgcc

SEQ ID NO: 2511 - DNA, 10 bp, Artificial Sequence
  synthetic Reed-Solomon code for 8+2 base, 1 base error, 2 nocall correction
aattatcggg

SEQ ID NO: 2512 - DNA, 10 bp, Artificial Sequence
  synthetic Reed-Solomon code for 8+2 base, 1 base error, 2 nocall correction
gtttatcgac

SEQ ID NO: 2513 - DNA, 10 bp, Artificial Sequence
  synthetic Reed-Solomon code for 8+2 base, 1 base error, 2 nocall correction
aaaactcgcg

SEQ ID NO: 2514 - DNA, 10 bp, Artificial Sequence
  synthetic Reed-Solomon code for 8+2 base, 1 base error, 2 nocall correction
taaactcgaa

SEQ ID NO: 2515 - DNA, 10 bp, Artificial Sequence
  synthetic Reed-Solomon code for 8+2 base, 1 base error, 2 nocall correction
gagactcgca

SEQ ID NO: 2516 - DNA, 10 bp, Artificial Sequence
  synthetic Reed-Solomon code for 8+2 base, 1 base error, 2 nocall correction
tcgactcgta

SEQ ID NO: 2517 - DNA, 10 bp, Artificial Sequence
  synthetic Reed-Solomon code for 8+2 base, 1 base error, 2 nocall correction
ttgactcggc

SEQ ID NO: 2518 - DNA, 10 bp, Artificial Sequence
  synthetic Reed-Solomon code for 8+2 base, 1 base error, 2 nocall correction
aatactcgat

SEQ ID NO: 2519 - DNA, 10 bp, Artificial Sequence
  synthetic Reed-Solomon code for 8+2 base, 1 base error, 2 nocall correction
gaccctcgta

SEQ ID NO: 2520 - DNA, 10 bp, Artificial Sequence
  synthetic Reed-Solomon code for 8+2 base, 1 base error, 2 nocall correction
acccctcgag

SEQ ID NO: 2521 - DNA, 10 bp, Artificial Sequence
  synthetic Reed-Solomon code for 8+2 base, 1 base error, 2 nocall correction
tcccctcgca

SEQ ID NO: 2522 - DNA, 10 bp, Artificial Sequence
  synthetic Reed-Solomon code for 8+2 base, 1 base error, 2 nocall correction
tacgctcgat

SEQ ID NO: 2523 - DNA, 10 bp, Artificial Sequence
  synthetic Reed-Solomon code for 8+2 base, 1 base error, 2 nocall correction
tgggctcgga

SEQ ID NO: 2524 - DNA, 10 bp, Artificial Sequence
  synthetic Reed-Solomon code for 8+2 base, 1 base error, 2 nocall correction
catgctcgac

SEQ ID NO: 2525 - DNA, 10 bp, Artificial Sequence
  synthetic Reed-Solomon code for 8+2 base, 1 base error, 2 nocall correction
cgatctcgta

SEQ ID NO: 2526 - DNA, 10 bp, Artificial Sequence
  synthetic Reed-Solomon code for 8+2 base, 1 base error, 2 nocall correction
atatctcgtt

SEQ ID NO: 2527 - DNA, 10 bp, Artificial Sequence
  synthetic Reed-Solomon code for 8+2 base, 1 base error, 2 nocall correction
ccctctcggt

SEQ ID NO: 2528 - DNA, 10 bp, Artificial Sequence
  synthetic Reed-Solomon code for 8+2 base, 1 base error, 2 nocall correction
agctctcgtc

SEQ ID NO: 2529 - DNA, 10 bp, Artificial Sequence
  synthetic Reed-Solomon code for 8+2 base, 1 base error, 2 nocall correction
tcttctcggc

SEQ ID NO: 2530 - DNA, 10 bp, Artificial Sequence
  synthetic Reed-Solomon code for 8+2 base, 1 base error, 2 nocall correction
ttttctcgta

SEQ ID NO: 2531 - DNA, 10 bp, Artificial Sequence
  synthetic Reed-Solomon code for 8+2 base, 1 base error, 2 nocall correction
caaagtcgtt

SEQ ID NO: 2532 - DNA, 10 bp, Artificial Sequence
  synthetic Reed-Solomon code for 8+2 base, 1 base error, 2 nocall correction
ccgagtcgat

SEQ ID NO: 2533 - DNA, 10 bp, Artificial Sequence
  synthetic Reed-Solomon code for 8+2 base, 1 base error, 2 nocall correction
gatcgtcgac

SEQ ID NO: 2534 - DNA, 10 bp, Artificial Sequence
  synthetic Reed-Solomon code for 8+2 base, 1 base error, 2 nocall correction
attcgtcggg

SEQ ID NO: 2535 - DNA, 10 bp, Artificial Sequence
  synthetic Reed-Solomon code for 8+2 base, 1 base error, 2 nocall correction
aaaggtcgtc

SEQ ID NO: 2536 - DNA, 10 bp, Artificial Sequence
  synthetic Reed-Solomon code for 8+2 base, 1 base error, 2 nocall correction
cacggtcgta

SEQ ID NO: 2537 - DNA, 10 bp, Artificial Sequence
  synthetic Reed-Solomon code for 8+2 base, 1 base error, 2 nocall correction
acgggtcgac

SEQ ID NO: 2538 - DNA, 10 bp, Artificial Sequence
  synthetic Reed-Solomon code for 8+2 base, 1 base error, 2 nocall correction
tgatgtcgat

SEQ ID NO: 2539 - DNA, 10 bp, Artificial Sequence
  synthetic Reed-Solomon code for 8+2 base, 1 base error, 2 nocall correction
ctatgtcgcg

SEQ ID NO: 2540 - DNA, 10 bp, Artificial Sequence
  synthetic Reed-Solomon code for 8+2 base, 1 base error, 2 nocall correction
ttctgtcgac

SEQ ID NO: 2541 - DNA, 10 bp, Artificial Sequence
  synthetic Reed-Solomon code for 8+2 base, 1 base error, 2 nocall correction
gggtgtcgct

SEQ ID NO: 2542 - DNA, 10 bp, Artificial Sequence
  synthetic Reed-Solomon code for 8+2 base, 1 base error, 2 nocall correction
agttgtcgaa

SEQ ID NO: 2543 - DNA, 10 bp, Artificial Sequence
  synthetic Reed-Solomon code for 8+2 base, 1 base error, 2 nocall correction
tgttgtcgcg

SEQ ID NO: 2544 - DNA, 10 bp, Artificial Sequence
  synthetic Reed-Solomon code for 8+2 base, 1 base error, 2 nocall correction
ctttgtcgat

SEQ ID NO: 2545 - DNA, 10 bp, Artificial Sequence
  synthetic Reed-Solomon code for 8+2 base, 1 base error, 2 nocall correction
ggcattcgaa

SEQ ID NO: 2546 - DNA, 10 bp, Artificial Sequence
  synthetic Reed-Solomon code for 8+2 base, 1 base error, 2 nocall correction
gagattcggt

SEQ ID NO: 2547 - DNA, 10 bp, Artificial Sequence
  synthetic Reed-Solomon code for 8+2 base, 1 base error, 2 nocall correction
tatattcggg

SEQ ID NO: 2548 - DNA, 10 bp, Artificial Sequence
  synthetic Reed-Solomon code for 8+2 base, 1 base error, 2 nocall correction
tgacttcgta

SEQ ID NO: 2549 - DNA, 10 bp, Artificial Sequence
  synthetic Reed-Solomon code for 8+2 base, 1 base error, 2 nocall correction
tcccttcggt

SEQ ID NO: 2550 - DNA, 10 bp, Artificial Sequence
  synthetic Reed-Solomon code for 8+2 base, 1 base error, 2 nocall correction
cctcttcggc

SEQ ID NO: 2551 - DNA, 10 bp, Artificial Sequence
  synthetic Reed-Solomon code for 8+2 base, 1 base error, 2 nocall correction
agtcttcgtt

SEQ ID NO: 2552 - DNA, 10 bp, Artificial Sequence
  synthetic Reed-Solomon code for 8+2 base, 1 base error, 2 nocall correction
cttcttcgta

SEQ ID NO: 2553 - DNA, 10 bp, Artificial Sequence
  synthetic Reed-Solomon code for 8+2 base, 1 base error, 2 nocall correction
ggagttcgat

SEQ ID NO: 2554 - DNA, 10 bp, Artificial Sequence
  synthetic Reed-Solomon code for 8+2 base, 1 base error, 2 nocall correction
aacgttcggg

SEQ ID NO: 2555 - DNA, 10 bp, Artificial Sequence
  synthetic Reed-Solomon code for 8+2 base, 1 base error, 2 nocall correction
gtcgttcgac

SEQ ID NO: 2556 - DNA, 10 bp, Artificial Sequence
  synthetic Reed-Solomon code for 8+2 base, 1 base error, 2 nocall correction
tgggttcgct

SEQ ID NO: 2557 - DNA, 10 bp, Artificial Sequence
  synthetic Reed-Solomon code for 8+2 base, 1 base error, 2 nocall correction
ctggttcgag

SEQ ID NO: 2558 - DNA, 10 bp, Artificial Sequence
  synthetic Reed-Solomon code for 8+2 base, 1 base error, 2 nocall correction
ggtgttcgcg

SEQ ID NO: 2559 - DNA, 10 bp, Artificial Sequence
  synthetic Reed-Solomon code for 8+2 base, 1 base error, 2 nocall correction
acatttcgcc

SEQ ID NO: 2560 - DNA, 10 bp, Artificial Sequence
  synthetic Reed-Solomon code for 8+2 base, 1 base error, 2 nocall correction
ccctttcgca

SEQ ID NO: 2561 - DNA, 10 bp, Artificial Sequence
  synthetic Reed-Solomon code for 8+2 base, 1 base error, 2 nocall correction
ggaaaaggcg

SEQ ID NO: 2562 - DNA, 10 bp, Artificial Sequence
  synthetic Reed-Solomon code for 8+2 base, 1 base error, 2 nocall correction
aggaaaggca

SEQ ID NO: 2563 - DNA, 10 bp, Artificial Sequence
  synthetic Reed-Solomon code for 8+2 base, 1 base error, 2 nocall correction
tggaaaggag

SEQ ID NO: 2564 - DNA, 10 bp, Artificial Sequence
  synthetic Reed-Solomon code for 8+2 base, 1 base error, 2 nocall correction
ctgaaaggct

SEQ ID NO: 2565 - DNA, 10 bp, Artificial Sequence
  synthetic Reed-Solomon code for 8+2 base, 1 base error, 2 nocall correction
ggtaaaggat

SEQ ID NO: 2566 - DNA, 10 bp, Artificial Sequence
  synthetic Reed-Solomon code for 8+2 base, 1 base error, 2 nocall correction
acacaagggt

SEQ ID NO: 2567 - DNA, 10 bp, Artificial Sequence
  synthetic Reed-Solomon code for 8+2 base, 1 base error, 2 nocall correction
cgacaaggtc

SEQ ID NO: 2568 - DNA, 10 bp, Artificial Sequence
  synthetic Reed-Solomon code for 8+2 base, 1 base error, 2 nocall correction
agccaaggta

SEQ ID NO: 2569 - DNA, 10 bp, Artificial Sequence
  synthetic Reed-Solomon code for 8+2 base, 1 base error, 2 nocall correction
ctccaaggtt

SEQ ID NO: 2570 - DNA, 10 bp, Artificial Sequence
  synthetic Reed-Solomon code for 8+2 base, 1 base error, 2 nocall correction
tctcaaggga

SEQ ID NO: 2571 - DNA, 10 bp, Artificial Sequence
  synthetic Reed-Solomon code for 8+2 base, 1 base error, 2 nocall correction
tttcaaggtc

SEQ ID NO: 2572 - DNA, 10 bp, Artificial Sequence
  synthetic Reed-Solomon code for 8+2 base, 1 base error, 2 nocall correction
taagaagggg

SEQ ID NO: 2573 - DNA, 10 bp, Artificial Sequence
  synthetic Reed-Solomon code for 8+2 base, 1 base error, 2 nocall correction
atggaaggcc

SEQ ID NO: 2574 - DNA, 10 bp, Artificial Sequence
  synthetic Reed-Solomon code for 8+2 base, 1 base error, 2 nocall correction
ccataaggag

SEQ ID NO: 2575 - DNA, 10 bp, Artificial Sequence
  synthetic Reed-Solomon code for 8+2 base, 1 base error, 2 nocall correction
gactaaggtc

SEQ ID NO: 2576 - DNA, 10 bp, Artificial Sequence
  synthetic Reed-Solomon code for 8+2 base, 1 base error, 2 nocall correction
tcctaaggcc

SEQ ID NO: 2577 - DNA, 10 bp, Artificial Sequence
  synthetic Reed-Solomon code for 8+2 base, 1 base error, 2 nocall correction
cagtaaggtg

SEQ ID NO: 2578 - DNA, 10 bp, Artificial Sequence
  synthetic Reed-Solomon code for 8+2 base, 1 base error, 2 nocall correction
ccttaaggct

SEQ ID NO: 2579 - DNA, 10 bp, Artificial Sequence
  synthetic Reed-Solomon code for 8+2 base, 1 base error, 2 nocall correction
ccaacagggt

SEQ ID NO: 2580 - DNA, 10 bp, Artificial Sequence
  synthetic Reed-Solomon code for 8+2 base, 1 base error, 2 nocall correction
agaacaggtc

SEQ ID NO: 2581 - DNA, 10 bp, Artificial Sequence
  synthetic Reed-Solomon code for 8+2 base, 1 base error, 2 nocall correction
cgcacaggta

SEQ ID NO: 2582 - DNA, 10 bp, Artificial Sequence
  synthetic Reed-Solomon code for 8+2 base, 1 base error, 2 nocall correction
atcacaggtt

SEQ ID NO: 2583 - DNA, 10 bp, Artificial Sequence
  synthetic Reed-Solomon code for 8+2 base, 1 base error, 2 nocall correction
cggccaggca

SEQ ID NO: 2584 - DNA, 10 bp, Artificial Sequence
  synthetic Reed-Solomon code for 8+2 base, 1 base error, 2 nocall correction
atgccaggct

SEQ ID NO: 2585 - DNA, 10 bp, Artificial Sequence
  synthetic Reed-Solomon code for 8+2 base, 1 base error, 2 nocall correction
gttccaggaa

SEQ ID NO: 2586 - DNA, 10 bp, Artificial Sequence
  synthetic Reed-Solomon code for 8+2 base, 1 base error, 2 nocall correction
acagcagggc

SEQ ID NO: 2587 - DNA, 10 bp, Artificial Sequence
  synthetic Reed-Solomon code for 8+2 base, 1 base error, 2 nocall correction
cgagcaggtt

SEQ ID NO: 2588 - DNA, 10 bp, Artificial Sequence
  synthetic Reed-Solomon code for 8+2 base, 1 base error, 2 nocall correction
atagcaggta

SEQ ID NO: 2589 - DNA, 10 bp, Artificial Sequence
  synthetic Reed-Solomon code for 8+2 base, 1 base error, 2 nocall correction
cccgcaggga

SEQ ID NO: 2590 - DNA, 10 bp, Artificial Sequence
  synthetic Reed-Solomon code for 8+2 base, 1 base error, 2 nocall correction
ctcgcaggtc

SEQ ID NO: 2591 - DNA, 10 bp, Artificial Sequence
  synthetic Reed-Solomon code for 8+2 base, 1 base error, 2 nocall correction
gtggcaggtg

SEQ ID NO: 2592 - DNA, 10 bp, Artificial Sequence
  synthetic Reed-Solomon code for 8+2 base, 1 base error, 2 nocall correction
tttgcaggtt

SEQ ID NO: 2593 - DNA, 10 bp, Artificial Sequence
  synthetic Reed-Solomon code for 8+2 base, 1 base error, 2 nocall correction
aactcaggcg

SEQ ID NO: 2594 - DNA, 10 bp, Artificial Sequence
  synthetic Reed-Solomon code for 8+2 base, 1 base error, 2 nocall correction
tactcaggaa

SEQ ID NO: 2595 - DNA, 10 bp, Artificial Sequence
  synthetic Reed-Solomon code for 8+2 base, 1 base error, 2 nocall correction
tggtcagggt

SEQ ID NO: 2596 - DNA, 10 bp, Artificial Sequence
  synthetic Reed-Solomon code for 8+2 base, 1 base error, 2 nocall correction
ggttcagggg

SEQ ID NO: 2597 - DNA, 10 bp, Artificial Sequence
  synthetic Reed-Solomon code for 8+2 base, 1 base error, 2 nocall correction
ttaagaggac

SEQ ID NO: 2598 - DNA, 10 bp, Artificial Sequence
  synthetic Reed-Solomon code for 8+2 base, 1 base error, 2 nocall correction
tgcagaggat

SEQ ID NO: 2599 - DNA, 10 bp, Artificial Sequence
  synthetic Reed-Solomon code for 8+2 base, 1 base error, 2 nocall correction
ctcagaggcg

SEQ ID NO: 2600 - DNA, 10 bp, Artificial Sequence
  synthetic Reed-Solomon code for 8+2 base, 1 base error, 2 nocall correction
tagagaggga

SEQ ID NO: 2601 - DNA, 10 bp, Artificial Sequence
  synthetic Reed-Solomon code for 8+2 base, 1 base error, 2 nocall correction
gtgagaggcc

SEQ ID NO: 2602 - DNA, 10 bp, Artificial Sequence
  synthetic Reed-Solomon code for 8+2 base, 1 base error, 2 nocall correction
cgtagaggac

SEQ ID NO: 2603 - DNA, 10 bp, Artificial Sequence
  synthetic Reed-Solomon code for 8+2 base, 1 base error, 2 nocall correction
ggacgaggtt

SEQ ID NO: 2604 - DNA, 10 bp, Artificial Sequence
  synthetic Reed-Solomon code for 8+2 base, 1 base error, 2 nocall correction
gcccgaggga

SEQ ID NO: 2605 - DNA, 10 bp, Artificial Sequence
  synthetic Reed-Solomon code for 8+2 base, 1 base error, 2 nocall correction
gtccgaggtc

SEQ ID NO: 2606 - DNA, 10 bp, Artificial Sequence
  synthetic Reed-Solomon code for 8+2 base, 1 base error, 2 nocall correction
ctgcgaggtg

SEQ ID NO: 2607 - DNA, 10 bp, Artificial Sequence
  synthetic Reed-Solomon code for 8+2 base, 1 base error, 2 nocall correction
agaggaggcg

SEQ ID NO: 2608 - DNA, 10 bp, Artificial Sequence
  synthetic Reed-Solomon code for 8+2 base, 1 base error, 2 nocall correction
tgaggaggaa

SEQ ID NO: 2609 - DNA, 10 bp, Artificial Sequence
  synthetic Reed-Solomon code for 8+2 base, 1 base error, 2 nocall correction
gggggaggca

SEQ ID NO: 2610 - DNA, 10 bp, Artificial Sequence
  synthetic Reed-Solomon code for 8+2 base, 1 base error, 2 nocall correction
agtggaggat

SEQ ID NO: 2611 - DNA, 10 bp, Artificial Sequence
  synthetic Reed-Solomon code for 8+2 base, 1 base error, 2 nocall correction
cttggaggaa

SEQ ID NO: 2612 - DNA, 10 bp, Artificial Sequence
  synthetic Reed-Solomon code for 8+2 base, 1 base error, 2 nocall correction
cactgaggtt

SEQ ID NO: 2613 - DNA, 10 bp, Artificial Sequence
  synthetic Reed-Solomon code for 8+2 base, 1 base error, 2 nocall correction
tattgaggtc

SEQ ID NO: 2614 - DNA, 10 bp, Artificial Sequence
  synthetic Reed-Solomon code for 8+2 base, 1 base error, 2 nocall correction
gcttgaggcc

SEQ ID NO: 2615 - DNA, 10 bp, Artificial Sequence
  synthetic Reed-Solomon code for 8+2 base, 1 base error, 2 nocall correction
ccaataggca

SEQ ID NO: 2616 - DNA, 10 bp, Artificial Sequence
  synthetic Reed-Solomon code for 8+2 base, 1 base error, 2 nocall correction
accataggcc

SEQ ID NO: 2617 - DNA, 10 bp, Artificial Sequence
  synthetic Reed-Solomon code for 8+2 base, 1 base error, 2 nocall correction
aaactaggac

SEQ ID NO: 2618 - DNA, 10 bp, Artificial Sequence
  synthetic Reed-Solomon code for 8+2 base, 1 base error, 2 nocall correction
gtactagggg

SEQ ID NO: 2619 - DNA, 10 bp, Artificial Sequence
  synthetic Reed-Solomon code for 8+2 base, 1 base error, 2 nocall correction
cacctaggaa

SEQ ID NO: 2620 - DNA, 10 bp, Artificial Sequence
  synthetic Reed-Solomon code for 8+2 base, 1 base error, 2 nocall correction
acgctaggtc

SEQ ID NO: 2621 - DNA, 10 bp, Artificial Sequence
  synthetic Reed-Solomon code for 8+2 base, 1 base error, 2 nocall correction
cggctagggt

SEQ ID NO: 2622 - DNA, 10 bp, Artificial Sequence
  synthetic Reed-Solomon code for 8+2 base, 1 base error, 2 nocall correction
atgctaggga

SEQ ID NO: 2623 - DNA, 10 bp, Artificial Sequence
  synthetic Reed-Solomon code for 8+2 base, 1 base error, 2 nocall correction
cccgtaggct

SEQ ID NO: 2624 - DNA, 10 bp, Artificial Sequence
  synthetic Reed-Solomon code for 8+2 base, 1 base error, 2 nocall correction
gatgtaggtc

SEQ ID NO: 2625 - DNA, 10 bp, Artificial Sequence
  synthetic Reed-Solomon code for 8+2 base, 1 base error, 2 nocall correction
tctgtaggcc

SEQ ID NO: 2626 - DNA, 10 bp, Artificial Sequence
  synthetic Reed-Solomon code for 8+2 base, 1 base error, 2 nocall correction
ggattaggaa

SEQ ID NO: 2627 - DNA, 10 bp, Artificial Sequence
  synthetic Reed-Solomon code for 8+2 base, 1 base error, 2 nocall correction
aggttaggag

SEQ ID NO: 2628 - DNA, 10 bp, Artificial Sequence
  synthetic Reed-Solomon code for 8+2 base, 1 base error, 2 nocall correction
tggttaggca

SEQ ID NO: 2629 - DNA, 10 bp, Artificial Sequence
  synthetic Reed-Solomon code for 8+2 base, 1 base error, 2 nocall correction
caaaacgggt

SEQ ID NO: 2630 - DNA, 10 bp, Artificial Sequence
  synthetic Reed-Solomon code for 8+2 base, 1 base error, 2 nocall correction
aggaacggac

SEQ ID NO: 2631 - DNA, 10 bp, Artificial Sequence
  synthetic Reed-Solomon code for 8+2 base, 1 base error, 2 nocall correction
attcacggtg

SEQ ID NO: 2632 - DNA, 10 bp, Artificial Sequence
  synthetic Reed-Solomon code for 8+2 base, 1 base error, 2 nocall correction
aaagacgggc

SEQ ID NO: 2633 - DNA, 10 bp, Artificial Sequence
  synthetic Reed-Solomon code for 8+2 base, 1 base error, 2 nocall correction
gtagacggag

SEQ ID NO: 2634 - DNA, 10 bp, Artificial Sequence
  synthetic Reed-Solomon code for 8+2 base, 1 base error, 2 nocall correction
cacgacggga

SEQ ID NO: 2635 - DNA, 10 bp, Artificial Sequence
  synthetic Reed-Solomon code for 8+2 base, 1 base error, 2 nocall correction
cgggacggat

SEQ ID NO: 2636 - DNA, 10 bp, Artificial Sequence
  synthetic Reed-Solomon code for 8+2 base, 1 base error, 2 nocall correction
atggacggaa

SEQ ID NO: 2637 - DNA, 10 bp, Artificial Sequence
  synthetic Reed-Solomon code for 8+2 base, 1 base error, 2 nocall correction
ttggacggcg

SEQ ID NO: 2638 - DNA, 10 bp, Artificial Sequence
  synthetic Reed-Solomon code for 8+2 base, 1 base error, 2 nocall correction
gttgacggct

SEQ ID NO: 2639 - DNA, 10 bp, Artificial Sequence
  synthetic Reed-Solomon code for 8+2 base, 1 base error, 2 nocall correction
acctacggcg

SEQ ID NO: 2640 - DNA, 10 bp, Artificial Sequence
  synthetic Reed-Solomon code for 8+2 base, 1 base error, 2 nocall correction
tcctacggaa

SEQ ID NO: 2641 - DNA, 10 bp, Artificial Sequence
  synthetic Reed-Solomon code for 8+2 base, 1 base error, 2 nocall correction
tgaaccggtg

SEQ ID NO: 2642 - DNA, 10 bp, Artificial Sequence
  synthetic Reed-Solomon code for 8+2 base, 1 base error, 2 nocall correction
cttaccggtg

SEQ ID NO: 2643 - DNA, 10 bp, Artificial Sequence
  synthetic Reed-Solomon code for 8+2 base, 1 base error, 2 nocall correction
aaacccgggt

SEQ ID NO: 2644 - DNA, 10 bp, Artificial Sequence
  synthetic Reed-Solomon code for 8+2 base, 1 base error, 2 nocall correction
ggccccggag

SEQ ID NO: 2645 - DNA, 10 bp, Artificial Sequence
  synthetic Reed-Solomon code for 8+2 base, 1 base error, 2 nocall correction
cggcccggac

SEQ ID NO: 2646 - DNA, 10 bp, Artificial Sequence
  synthetic Reed-Solomon code for 8+2 base, 1 base error, 2 nocall correction
tatcccggga

SEQ ID NO: 2647 - DNA, 10 bp, Artificial Sequence
  synthetic Reed-Solomon code for 8+2 base, 1 base error, 2 nocall correction
gttcccggcc

SEQ ID NO: 2648 - DNA, 10 bp, Artificial Sequence
  synthetic Reed-Solomon code for 8+2 base, 1 base error, 2 nocall correction
tcagccgggg

SEQ ID NO: 2649 - DNA, 10 bp, Artificial Sequence
  synthetic Reed-Solomon code for 8+2 base, 1 base error, 2 nocall correction
caatccggag

SEQ ID NO: 2650 - DNA, 10 bp, Artificial Sequence
  synthetic Reed-Solomon code for 8+2 base, 1 base error, 2 nocall correction
tactccggcc

SEQ ID NO: 2651 - DNA, 10 bp, Artificial Sequence
  synthetic Reed-Solomon code for 8+2 base, 1 base error, 2 nocall correction
gcctccggtc

SEQ ID NO: 2652 - DNA, 10 bp, Artificial Sequence
  synthetic Reed-Solomon code for 8+2 base, 1 base error, 2 nocall correction
gtctccggga

SEQ ID NO: 2653 - DNA, 10 bp, Artificial Sequence
  synthetic Reed-Solomon code for 8+2 base, 1 base error, 2 nocall correction
ccgtccggtg

SEQ ID NO: 2654 - DNA, 10 bp, Artificial Sequence
  synthetic Reed-Solomon code for 8+2 base, 1 base error, 2 nocall correction
cattccggct

SEQ ID NO: 2655 - DNA, 10 bp, Artificial Sequence
  synthetic Reed-Solomon code for 8+2 base, 1 base error, 2 nocall correction
gaaagcgggc

SEQ ID NO: 2656 - DNA, 10 bp, Artificial Sequence
  synthetic Reed-Solomon code for 8+2 base, 1 base error, 2 nocall correction
ataagcggag

SEQ ID NO: 2657 - DNA, 10 bp, Artificial Sequence
  synthetic Reed-Solomon code for 8+2 base, 1 base error, 2 nocall correction
ttaagcggca

SEQ ID NO: 2658 - DNA, 10 bp, Artificial Sequence
  synthetic Reed-Solomon code for 8+2 base, 1 base error, 2 nocall correction
gtgagcggaa

SEQ ID NO: 2659 - DNA, 10 bp, Artificial Sequence
  synthetic Reed-Solomon code for 8+2 base, 1 base error, 2 nocall correction
cgtagcggca

SEQ ID NO: 2660 - DNA, 10 bp, Artificial Sequence
  synthetic Reed-Solomon code for 8+2 base, 1 base error, 2 nocall correction
attagcggct

SEQ ID NO: 2661 - DNA, 10 bp, Artificial Sequence
  synthetic Reed-Solomon code for 8+2 base, 1 base error, 2 nocall correction
tgaggcggcc

SEQ ID NO: 2662 - DNA, 10 bp, Artificial Sequence
  synthetic Reed-Solomon code for 8+2 base, 1 base error, 2 nocall correction
cgcggcggag

SEQ ID NO: 2663 - DNA, 10 bp, Artificial Sequence
  synthetic Reed-Solomon code for 8+2 base, 1 base error, 2 nocall correction
ttcggcggct

SEQ ID NO: 2664 - DNA, 10 bp, Artificial Sequence
  synthetic Reed-Solomon code for 8+2 base, 1 base error, 2 nocall correction
gggggcggac

SEQ ID NO: 2665 - DNA, 10 bp, Artificial Sequence
  synthetic Reed-Solomon code for 8+2 base, 1 base error, 2 nocall correction
cttggcggcc

SEQ ID NO: 2666 - DNA, 10 bp, Artificial Sequence
  synthetic Reed-Solomon code for 8+2 base, 1 base error, 2 nocall correction
acgtgcggct

SEQ ID NO: 2667 - DNA, 10 bp, Artificial Sequence
  synthetic Reed-Solomon code for 8+2 base, 1 base error, 2 nocall correction
aattgcggtg

SEQ ID NO: 2668 - DNA, 10 bp, Artificial Sequence
  synthetic Reed-Solomon code for 8+2 base, 1 base error, 2 nocall correction
gcttgcggaa

SEQ ID NO: 2669 - DNA, 10 bp, Artificial Sequence
  synthetic Reed-Solomon code for 8+2 base, 1 base error, 2 nocall correction
ccaatcggac

SEQ ID NO: 2670 - DNA, 10 bp, Artificial Sequence
  synthetic Reed-Solomon code for 8+2 base, 1 base error, 2 nocall correction
gacatcggtg

SEQ ID NO: 2671 - DNA, 10 bp, Artificial Sequence
  synthetic Reed-Solomon code for 8+2 base, 1 base error, 2 nocall correction
accatcggaa

SEQ ID NO: 2672 - DNA, 10 bp, Artificial Sequence
  synthetic Reed-Solomon code for 8+2 base, 1 base error, 2 nocall correction
tccatcggcg

SEQ ID NO: 2673 - DNA, 10 bp, Artificial Sequence
  synthetic Reed-Solomon code for 8+2 base, 1 base error, 2 nocall correction
cagatcggtc

SEQ ID NO: 2674 - DNA, 10 bp, Artificial Sequence
  synthetic Reed-Solomon code for 8+2 base, 1 base error, 2 nocall correction
aaactcggca

SEQ ID NO: 2675 - DNA, 10 bp, Artificial Sequence
  synthetic Reed-Solomon code for 8+2 base, 1 base error, 2 nocall correction
taactcggag

SEQ ID NO: 2676 - DNA, 10 bp, Artificial Sequence
  synthetic Reed-Solomon code for 8+2 base, 1 base error, 2 nocall correction
cacctcggcc

SEQ ID NO: 2677 - DNA, 10 bp, Artificial Sequence
  synthetic Reed-Solomon code for 8+2 base, 1 base error, 2 nocall correction
gagctcggcg

SEQ ID NO: 2678 - DNA, 10 bp, Artificial Sequence
  synthetic Reed-Solomon code for 8+2 base, 1 base error, 2 nocall correction
tcgctcggtg

SEQ ID NO: 2679 - DNA, 10 bp, Artificial Sequence
  synthetic Reed-Solomon code for 8+2 base, 1 base error, 2 nocall correction
tatctcggct

SEQ ID NO: 2680 - DNA, 10 bp, Artificial Sequence
  synthetic Reed-Solomon code for 8+2 base, 1 base error, 2 nocall correction
gctctcggtt

SEQ ID NO: 2681 - DNA, 10 bp, Artificial Sequence
  synthetic Reed-Solomon code for 8+2 base, 1 base error, 2 nocall correction
acagtcggat

SEQ ID NO: 2682 - DNA, 10 bp, Artificial Sequence
  synthetic Reed-Solomon code for 8+2 base, 1 base error, 2 nocall correction
aaggtcggtt

SEQ ID NO: 2683 - DNA, 10 bp, Artificial Sequence
  synthetic Reed-Solomon code for 8+2 base, 1 base error, 2 nocall correction
actgtcggcg

SEQ ID NO: 2684 - DNA, 10 bp, Artificial Sequence
  synthetic Reed-Solomon code for 8+2 base, 1 base error, 2 nocall correction
tctgtcggaa

SEQ ID NO: 2685 - DNA, 10 bp, Artificial Sequence
  synthetic Reed-Solomon code for 8+2 base, 1 base error, 2 nocall correction
ggattcggcc

SEQ ID NO: 2686 - DNA, 10 bp, Artificial Sequence
  synthetic Reed-Solomon code for 8+2 base, 1 base error, 2 nocall correction
gtcttcggct

SEQ ID NO: 2687 - DNA, 10 bp, Artificial Sequence
  synthetic Reed-Solomon code for 8+2 base, 1 base error, 2 nocall correction
tggttcggac

SEQ ID NO: 2688 - DNA, 10 bp, Artificial Sequence
  synthetic Reed-Solomon code for 8+2 base, 1 base error, 2 nocall correction
catttcggga

SEQ ID NO: 2689 - DNA, 10 bp, Artificial Sequence
  synthetic Reed-Solomon code for 8+2 base, 1 base error, 2 nocall correction
tacaagggat

SEQ ID NO: 2690 - DNA, 10 bp, Artificial Sequence
  synthetic Reed-Solomon code for 8+2 base, 1 base error, 2 nocall correction
tggaagggga

SEQ ID NO: 2691 - DNA, 10 bp, Artificial Sequence
  synthetic Reed-Solomon code for 8+2 base, 1 base error, 2 nocall correction
cataagggac

SEQ ID NO: 2692 - DNA, 10 bp, Artificial Sequence
  synthetic Reed-Solomon code for 8+2 base, 1 base error, 2 nocall correction
gaacagggtt

SEQ ID NO: 2693 - DNA, 10 bp, Artificial Sequence
  synthetic Reed-Solomon code for 8+2 base, 1 base error, 2 nocall correction
tcacagggct

SEQ ID NO: 2694 - DNA, 10 bp, Artificial Sequence
  synthetic Reed-Solomon code for 8+2 base, 1 base error, 2 nocall correction
gcgcagggat

SEQ ID NO: 2695 - DNA, 10 bp, Artificial Sequence
  synthetic Reed-Solomon code for 8+2 base, 1 base error, 2 nocall correction
actcagggca

SEQ ID NO: 2696 - DNA, 10 bp, Artificial Sequence
  synthetic Reed-Solomon code for 8+2 base, 1 base error, 2 nocall correction
tctcagggag

SEQ ID NO: 2697 - DNA, 10 bp, Artificial Sequence
  synthetic Reed-Solomon code for 8+2 base, 1 base error, 2 nocall correction
aaagagggcg

SEQ ID NO: 2698 - DNA, 10 bp, Artificial Sequence
  synthetic Reed-Solomon code for 8+2 base, 1 base error, 2 nocall correction
taagagggaa

SEQ ID NO: 2699 - DNA, 10 bp, Artificial Sequence
  synthetic Reed-Solomon code for 8+2 base, 1 base error, 2 nocall correction
gaggagggca

SEQ ID NO: 2700 - DNA, 10 bp, Artificial Sequence
  synthetic Reed-Solomon code for 8+2 base, 1 base error, 2 nocall correction
tcggagggta

SEQ ID NO: 2701 - DNA, 10 bp, Artificial Sequence
  synthetic Reed-Solomon code for 8+2 base, 1 base error, 2 nocall correction
ttggaggggc

SEQ ID NO: 2702 - DNA, 10 bp, Artificial Sequence
  synthetic Reed-Solomon code for 8+2 base, 1 base error, 2 nocall correction
aatgagggat

SEQ ID NO: 2703 - DNA, 10 bp, Artificial Sequence
  synthetic Reed-Solomon code for 8+2 base, 1 base error, 2 nocall correction
ccatagggga

SEQ ID NO: 2704 - DNA, 10 bp, Artificial Sequence
  synthetic Reed-Solomon code for 8+2 base, 1 base error, 2 nocall correction
ctatagggtc

SEQ ID NO: 2705 - DNA, 10 bp, Artificial Sequence
  synthetic Reed-Solomon code for 8+2 base, 1 base error, 2 nocall correction
acctaggggc

SEQ ID NO: 2706 - DNA, 10 bp, Artificial Sequence
  synthetic Reed-Solomon code for 8+2 base, 1 base error, 2 nocall correction
cgctagggtt

SEQ ID NO: 2707 - DNA, 10 bp, Artificial Sequence
  synthetic Reed-Solomon code for 8+2 base, 1 base error, 2 nocall correction
atctagggta

SEQ ID NO: 2708 - DNA, 10 bp, Artificial Sequence
  synthetic Reed-Solomon code for 8+2 base, 1 base error, 2 nocall correction
tgttagggtc

SEQ ID NO: 2709 - DNA, 10 bp, Artificial Sequence
  synthetic Reed-Solomon code for 8+2 base, 1 base error, 2 nocall correction
cctacgggca

SEQ ID NO: 2710 - DNA, 10 bp, Artificial Sequence
  synthetic Reed-Solomon code for 8+2 base, 1 base error, 2 nocall correction
ttgccggggt

SEQ ID NO: 2711 - DNA, 10 bp, Artificial Sequence
  synthetic Reed-Solomon code for 8+2 base, 1 base error, 2 nocall correction
aatccgggac

SEQ ID NO: 2712 - DNA, 10 bp, Artificial Sequence
  synthetic Reed-Solomon code for 8+2 base, 1 base error, 2 nocall correction
gttccggggg

SEQ ID NO: 2713 - DNA, 10 bp, Artificial Sequence
  synthetic Reed-Solomon code for 8+2 base, 1 base error, 2 nocall correction
gaagcgggtc

SEQ ID NO: 2714 - DNA, 10 bp, Artificial Sequence
  synthetic Reed-Solomon code for 8+2 base, 1 base error, 2 nocall correction
tcagcgggcc

SEQ ID NO: 2715 - DNA, 10 bp, Artificial Sequence
  synthetic Reed-Solomon code for 8+2 base, 1 base error, 2 nocall correction
cccgcgggag

SEQ ID NO: 2716 - DNA, 10 bp, Artificial Sequence
  synthetic Reed-Solomon code for 8+2 base, 1 base error, 2 nocall correction
gcggcgggac

SEQ ID NO: 2717 - DNA, 10 bp, Artificial Sequence
  synthetic Reed-Solomon code for 8+2 base, 1 base error, 2 nocall correction
tactcggggg

SEQ ID NO: 2718 - DNA, 10 bp, Artificial Sequence
  synthetic Reed-Solomon code for 8+2 base, 1 base error, 2 nocall correction
aggtcgggct

SEQ ID NO: 2719 - DNA, 10 bp, Artificial Sequence
  synthetic Reed-Solomon code for 8+2 base, 1 base error, 2 nocall correction
ctgtcgggca

SEQ ID NO: 2720 - DNA, 10 bp, Artificial Sequence
  synthetic Reed-Solomon code for 8+2 base, 1 base error, 2 nocall correction
ggttcgggaa

SEQ ID NO: 2721 - DNA, 10 bp, Artificial Sequence
  synthetic Reed-Solomon code for 8+2 base, 1 base error, 2 nocall correction
gaaaggggcg

SEQ ID NO: 2722 - DNA, 10 bp, Artificial Sequence
  synthetic Reed-Solomon code for 8+2 base, 1 base error, 2 nocall correction
tcaaggggtg

SEQ ID NO: 2723 - DNA, 10 bp, Artificial Sequence
  synthetic Reed-Solomon code for 8+2 base, 1 base error, 2 nocall correction
aagaggggca

SEQ ID NO: 2724 - DNA, 10 bp, Artificial Sequence
  synthetic Reed-Solomon code for 8+2 base, 1 base error, 2 nocall correction
tagaggggag

SEQ ID NO: 2725 - DNA, 10 bp, Artificial Sequence
  synthetic Reed-Solomon code for 8+2 base, 1 base error, 2 nocall correction
gataggggat

SEQ ID NO: 2726 - DNA, 10 bp, Artificial Sequence
  synthetic Reed-Solomon code for 8+2 base, 1 base error, 2 nocall correction
caacggggtc

SEQ ID NO: 2727 - DNA, 10 bp, Artificial Sequence
  synthetic Reed-Solomon code for 8+2 base, 1 base error, 2 nocall correction
aaccggggta

SEQ ID NO: 2728 - DNA, 10 bp, Artificial Sequence
  synthetic Reed-Solomon code for 8+2 base, 1 base error, 2 nocall correction
gcccggggag

SEQ ID NO: 2729 - DNA, 10 bp, Artificial Sequence
  synthetic Reed-Solomon code for 8+2 base, 1 base error, 2 nocall correction
ccgcggggac

SEQ ID NO: 2730 - DNA, 10 bp, Artificial Sequence
  synthetic Reed-Solomon code for 8+2 base, 1 base error, 2 nocall correction
tgaggggggg

SEQ ID NO: 2731 - DNA, 10 bp, Artificial Sequence
  synthetic Reed-Solomon code for 8+2 base, 1 base error, 2 nocall correction
cttggggggg

SEQ ID NO: 2732 - DNA, 10 bp, Artificial Sequence
  synthetic Reed-Solomon code for 8+2 base, 1 base error, 2 nocall correction
gtatggggtt

SEQ ID NO: 2733 - DNA, 10 bp, Artificial Sequence
  synthetic Reed-Solomon code for 8+2 base, 1 base error, 2 nocall correction
ggctggggtc

SEQ ID NO: 2734 - DNA, 10 bp, Artificial Sequence
  synthetic Reed-Solomon code for 8+2 base, 1 base error, 2 nocall correction
cggtggggtg

SEQ ID NO: 2735 - DNA, 10 bp, Artificial Sequence
  synthetic Reed-Solomon code for 8+2 base, 1 base error, 2 nocall correction
tccatggggc

SEQ ID NO: 2736 - DNA, 10 bp, Artificial Sequence
  synthetic Reed-Solomon code for 8+2 base, 1 base error, 2 nocall correction
ttcatgggta

SEQ ID NO: 2737 - DNA, 10 bp, Artificial Sequence
  synthetic Reed-Solomon code for 8+2 base, 1 base error, 2 nocall correction
cctatggggt

SEQ ID NO: 2738 - DNA, 10 bp, Artificial Sequence
  synthetic Reed-Solomon code for 8+2 base, 1 base error, 2 nocall correction
agtatgggtc

SEQ ID NO: 2739 - DNA, 10 bp, Artificial Sequence
  synthetic Reed-Solomon code for 8+2 base, 1 base error, 2 nocall correction
gtactgggaa

SEQ ID NO: 2740 - DNA, 10 bp, Artificial Sequence
  synthetic Reed-Solomon code for 8+2 base, 1 base error, 2 nocall correction
cacctggggg

SEQ ID NO: 2741 - DNA, 10 bp, Artificial Sequence
  synthetic Reed-Solomon code for 8+2 base, 1 base error, 2 nocall correction
gagctggggc

SEQ ID NO: 2742 - DNA, 10 bp, Artificial Sequence
  synthetic Reed-Solomon code for 8+2 base, 1 base error, 2 nocall correction
atgctgggag

SEQ ID NO: 2743 - DNA, 10 bp, Artificial Sequence
  synthetic Reed-Solomon code for 8+2 base, 1 base error, 2 nocall correction
ttgctgggca

SEQ ID NO: 2744 - DNA, 10 bp, Artificial Sequence
  synthetic Reed-Solomon code for 8+2 base, 1 base error, 2 nocall correction
ttagtgggtt

SEQ ID NO: 2745 - DNA, 10 bp, Artificial Sequence
  synthetic Reed-Solomon code for 8+2 base, 1 base error, 2 nocall correction
tgcgtgggtc

SEQ ID NO: 2746 - DNA, 10 bp, Artificial Sequence
  synthetic Reed-Solomon code for 8+2 base, 1 base error, 2 nocall correction
actgtggggc

SEQ ID NO: 2747 - DNA, 10 bp, Artificial Sequence
  synthetic Reed-Solomon code for 8+2 base, 1 base error, 2 nocall correction
cgtgtgggtt

SEQ ID NO: 2748 - DNA, 10 bp, Artificial Sequence
  synthetic Reed-Solomon code for 8+2 base, 1 base error, 2 nocall correction
attgtgggta

SEQ ID NO: 2749 - DNA, 10 bp, Artificial Sequence
  synthetic Reed-Solomon code for 8+2 base, 1 base error, 2 nocall correction
ggattggggg

SEQ ID NO: 2750 - DNA, 10 bp, Artificial Sequence
  synthetic Reed-Solomon code for 8+2 base, 1 base error, 2 nocall correction
aacttgggat

SEQ ID NO: 2751 - DNA, 10 bp, Artificial Sequence
  synthetic Reed-Solomon code for 8+2 base, 1 base error, 2 nocall correction
aggttgggga

SEQ ID NO: 2752 - DNA, 10 bp, Artificial Sequence
  synthetic Reed-Solomon code for 8+2 base, 1 base error, 2 nocall correction
ctgttggggt

SEQ ID NO: 2753 - DNA, 10 bp, Artificial Sequence
  synthetic Reed-Solomon code for 8+2 base, 1 base error, 2 nocall correction
ggtaatggta

SEQ ID NO: 2754 - DNA, 10 bp, Artificial Sequence
  synthetic Reed-Solomon code for 8+2 base, 1 base error, 2 nocall correction
gaacatgggg

SEQ ID NO: 2755 - DNA, 10 bp, Artificial Sequence
  synthetic Reed-Solomon code for 8+2 base, 1 base error, 2 nocall correction
atacatggac

SEQ ID NO: 2756 - DNA, 10 bp, Artificial Sequence
  synthetic Reed-Solomon code for 8+2 base, 1 base error, 2 nocall correction
agccatggat

SEQ ID NO: 2757 - DNA, 10 bp, Artificial Sequence
  synthetic Reed-Solomon code for 8+2 base, 1 base error, 2 nocall correction
ctccatggaa

SEQ ID NO: 2758 - DNA, 10 bp, Artificial Sequence
  synthetic Reed-Solomon code for 8+2 base, 1 base error, 2 nocall correction
aagcatggga

SEQ ID NO: 2759 - DNA, 10 bp, Artificial Sequence
  synthetic Reed-Solomon code for 8+2 base, 1 base error, 2 nocall correction
gctgatggga

SEQ ID NO: 2760 - DNA, 10 bp, Artificial Sequence
  synthetic Reed-Solomon code for 8+2 base, 1 base error, 2 nocall correction
gttgatggtc

SEQ ID NO: 2761 - DNA, 10 bp, Artificial Sequence
  synthetic Reed-Solomon code for 8+2 base, 1 base error, 2 nocall correction
cgctatgggg

SEQ ID NO: 2762 - DNA, 10 bp, Artificial Sequence
  synthetic Reed-Solomon code for 8+2 base, 1 base error, 2 nocall correction
gggtatgggc

SEQ ID NO: 2763 - DNA, 10 bp, Artificial Sequence
  synthetic Reed-Solomon code for 8+2 base, 1 base error, 2 nocall correction
ctaactggac

SEQ ID NO: 2764 - DNA, 10 bp, Artificial Sequence
  synthetic Reed-Solomon code for 8+2 base, 1 base error, 2 nocall correction
cgcactggat

SEQ ID NO: 2765 - DNA, 10 bp, Artificial Sequence
  synthetic Reed-Solomon code for 8+2 base, 1 base error, 2 nocall correction
atcactggaa

SEQ ID NO: 2766 - DNA, 10 bp, Artificial Sequence
  synthetic Reed-Solomon code for 8+2 base, 1 base error, 2 nocall correction
ttcactggcg

SEQ ID NO: 2767 - DNA, 10 bp, Artificial Sequence
  synthetic Reed-Solomon code for 8+2 base, 1 base error, 2 nocall correction
cagactggga

SEQ ID NO: 2768 - DNA, 10 bp, Artificial Sequence
  synthetic Reed-Solomon code for 8+2 base, 1 base error, 2 nocall correction
tgtactggac

SEQ ID NO: 2769 - DNA, 10 bp, Artificial Sequence
  synthetic Reed-Solomon code for 8+2 base, 1 base error, 2 nocall correction
ttgcctggtg

SEQ ID NO: 2770 - DNA, 10 bp, Artificial Sequence
  synthetic Reed-Solomon code for 8+2 base, 1 base error, 2 nocall correction
gttcctggtt

SEQ ID NO: 2771 - DNA, 10 bp, Artificial Sequence
  synthetic Reed-Solomon code for 8+2 base, 1 base error, 2 nocall correction
cgagctggaa

SEQ ID NO: 2772 - DNA, 10 bp, Artificial Sequence
  synthetic Reed-Solomon code for 8+2 base, 1 base error, 2 nocall correction
atagctggat

SEQ ID NO: 2773 - DNA, 10 bp, Artificial Sequence
  synthetic Reed-Solomon code for 8+2 base, 1 base error, 2 nocall correction
agcgctggac

SEQ ID NO: 2774 - DNA, 10 bp, Artificial Sequence
  synthetic Reed-Solomon code for 8+2 base, 1 base error, 2 nocall correction
attgctggcg

SEQ ID NO: 2775 - DNA, 10 bp, Artificial Sequence
  synthetic Reed-Solomon code for 8+2 base, 1 base error, 2 nocall correction
tttgctggaa

SEQ ID NO: 2776 - DNA, 10 bp, Artificial Sequence
  synthetic Reed-Solomon code for 8+2 base, 1 base error, 2 nocall correction
tactctggtt

SEQ ID NO: 2777 - DNA, 10 bp, Artificial Sequence
  synthetic Reed-Solomon code for 8+2 base, 1 base error, 2 nocall correction
gcctctggct

SEQ ID NO: 2778 - DNA, 10 bp, Artificial Sequence
  synthetic Reed-Solomon code for 8+2 base, 1 base error, 2 nocall correction
cattctggtc

SEQ ID NO: 2779 - DNA, 10 bp, Artificial Sequence
  synthetic Reed-Solomon code for 8+2 base, 1 base error, 2 nocall correction
tcaagtgggt

SEQ ID NO: 2780 - DNA, 10 bp, Artificial Sequence
  synthetic Reed-Solomon code for 8+2 base, 1 base error, 2 nocall correction
tgcagtggta

SEQ ID NO: 2781 - DNA, 10 bp, Artificial Sequence
  synthetic Reed-Solomon code for 8+2 base, 1 base error, 2 nocall correction
actagtggga

SEQ ID NO: 2782 - DNA, 10 bp, Artificial Sequence
  synthetic Reed-Solomon code for 8+2 base, 1 base error, 2 nocall correction
attagtggtc

SEQ ID NO: 2783 - DNA, 10 bp, Artificial Sequence
  synthetic Reed-Solomon code for 8+2 base, 1 base error, 2 nocall correction
ggacgtggaa

SEQ ID NO: 2784 - DNA, 10 bp, Artificial Sequence
  synthetic Reed-Solomon code for 8+2 base, 1 base error, 2 nocall correction
aggcgtggag

SEQ ID NO: 2785 - DNA, 10 bp, Artificial Sequence
  synthetic Reed-Solomon code for 8+2 base, 1 base error, 2 nocall correction
tggcgtggca

SEQ ID NO: 2786 - DNA, 10 bp, Artificial Sequence
  synthetic Reed-Solomon code for 8+2 base, 1 base error, 2 nocall correction
tgaggtggtt

SEQ ID NO: 2787 - DNA, 10 bp, Artificial Sequence
  synthetic Reed-Solomon code for 8+2 base, 1 base error, 2 nocall correction
tccggtggga

SEQ ID NO: 2788 - DNA, 10 bp, Artificial Sequence
  synthetic Reed-Solomon code for 8+2 base, 1 base error, 2 nocall correction
ttcggtggtc

SEQ ID NO: 2789 - DNA, 10 bp, Artificial Sequence
  synthetic Reed-Solomon code for 8+2 base, 1 base error, 2 nocall correction
agtggtggta

SEQ ID NO: 2790 - DNA, 10 bp, Artificial Sequence
  synthetic Reed-Solomon code for 8+2 base, 1 base error, 2 nocall correction
cttggtggtt

SEQ ID NO: 2791 - DNA, 10 bp, Artificial Sequence
  synthetic Reed-Solomon code for 8+2 base, 1 base error, 2 nocall correction
aaatgtggac

SEQ ID NO: 2792 - DNA, 10 bp, Artificial Sequence
  synthetic Reed-Solomon code for 8+2 base, 1 base error, 2 nocall correction
gtatgtgggg

SEQ ID NO: 2793 - DNA, 10 bp, Artificial Sequence
  synthetic Reed-Solomon code for 8+2 base, 1 base error, 2 nocall correction
cactgtggaa

SEQ ID NO: 2794 - DNA, 10 bp, Artificial Sequence
  synthetic Reed-Solomon code for 8+2 base, 1 base error, 2 nocall correction
acgtgtggtc

SEQ ID NO: 2795 - DNA, 10 bp, Artificial Sequence
  synthetic Reed-Solomon code for 8+2 base, 1 base error, 2 nocall correction
cggtgtgggt

SEQ ID NO: 2796 - DNA, 10 bp, Artificial Sequence
  synthetic Reed-Solomon code for 8+2 base, 1 base error, 2 nocall correction
atgtgtggga

SEQ ID NO: 2797 - DNA, 10 bp, Artificial Sequence
  synthetic Reed-Solomon code for 8+2 base, 1 base error, 2 nocall correction
cagattggct

SEQ ID NO: 2798 - DNA, 10 bp, Artificial Sequence
  synthetic Reed-Solomon code for 8+2 base, 1 base error, 2 nocall correction
cctattggtg

SEQ ID NO: 2799 - DNA, 10 bp, Artificial Sequence
  synthetic Reed-Solomon code for 8+2 base, 1 base error, 2 nocall correction
caccttggtt

SEQ ID NO: 2800 - DNA, 10 bp, Artificial Sequence
  synthetic Reed-Solomon code for 8+2 base, 1 base error, 2 nocall correction
tatcttggtc

SEQ ID NO: 2801 - DNA, 10 bp, Artificial Sequence
  synthetic Reed-Solomon code for 8+2 base, 1 base error, 2 nocall correction
gctcttggcc

SEQ ID NO: 2802 - DNA, 10 bp, Artificial Sequence
  synthetic Reed-Solomon code for 8+2 base, 1 base error, 2 nocall correction
ttagttgggg

SEQ ID NO: 2803 - DNA, 10 bp, Artificial Sequence
  synthetic Reed-Solomon code for 8+2 base, 1 base error, 2 nocall correction
aaggttggcc

SEQ ID NO: 2804 - DNA, 10 bp, Artificial Sequence
  synthetic Reed-Solomon code for 8+2 base, 1 base error, 2 nocall correction
cgtgttgggg

SEQ ID NO: 2805 - DNA, 10 bp, Artificial Sequence
  synthetic Reed-Solomon code for 8+2 base, 1 base error, 2 nocall correction
ggatttggtt

SEQ ID NO: 2806 - DNA, 10 bp, Artificial Sequence
  synthetic Reed-Solomon code for 8+2 base, 1 base error, 2 nocall correction
gcctttggga

SEQ ID NO: 2807 - DNA, 10 bp, Artificial Sequence
  synthetic Reed-Solomon code for 8+2 base, 1 base error, 2 nocall correction
gtctttggtc

SEQ ID NO: 2808 - DNA, 10 bp, Artificial Sequence
  synthetic Reed-Solomon code for 8+2 base, 1 base error, 2 nocall correction
ctgtttggtg

SEQ ID NO: 2809 - DNA, 10 bp, Artificial Sequence
  synthetic Reed-Solomon code for 8+2 base, 1 base error, 2 nocall correction
accaaatgat

SEQ ID NO: 2810 - DNA, 10 bp, Artificial Sequence
  synthetic Reed-Solomon code for 8+2 base, 1 base error, 2 nocall correction
aaacaatgct

SEQ ID NO: 2811 - DNA, 10 bp, Artificial Sequence
  synthetic Reed-Solomon code for 8+2 base, 1 base error, 2 nocall correction
aatcaatgag

SEQ ID NO: 2812 - DNA, 10 bp, Artificial Sequence
  synthetic Reed-Solomon code for 8+2 base, 1 base error, 2 nocall correction
tatcaatgca

SEQ ID NO: 2813 - DNA, 10 bp, Artificial Sequence
  synthetic Reed-Solomon code for 8+2 base, 1 base error, 2 nocall correction
gctcaatgta

SEQ ID NO: 2814 - DNA, 10 bp, Artificial Sequence
  synthetic Reed-Solomon code for 8+2 base, 1 base error, 2 nocall correction
gttcaatggc

SEQ ID NO: 2815 - DNA, 10 bp, Artificial Sequence
  synthetic Reed-Solomon code for 8+2 base, 1 base error, 2 nocall correction
gaagaatgtg

SEQ ID NO: 2816 - DNA, 10 bp, Artificial Sequence
  synthetic Reed-Solomon code for 8+2 base, 1 base error, 2 nocall correction
acagaatgaa

SEQ ID NO: 2817 - DNA, 10 bp, Artificial Sequence
  synthetic Reed-Solomon code for 8+2 base, 1 base error, 2 nocall correction
tcagaatgcg

SEQ ID NO: 2818 - DNA, 10 bp, Artificial Sequence
  synthetic Reed-Solomon code for 8+2 base, 1 base error, 2 nocall correction
cccgaatgac

SEQ ID NO: 2819 - DNA, 10 bp, Artificial Sequence
  synthetic Reed-Solomon code for 8+2 base, 1 base error, 2 nocall correction
aaggaatgta

SEQ ID NO: 2820 - DNA, 10 bp, Artificial Sequence
  synthetic Reed-Solomon code for 8+2 base, 1 base error, 2 nocall correction
gcggaatgag

SEQ ID NO: 2821 - DNA, 10 bp, Artificial Sequence
  synthetic Reed-Solomon code for 8+2 base, 1 base error, 2 nocall correction
tctgaatgat

SEQ ID NO: 2822 - DNA, 10 bp, Artificial Sequence
  synthetic Reed-Solomon code for 8+2 base, 1 base error, 2 nocall correction
tactaatggc

SEQ ID NO: 2823 - DNA, 10 bp, Artificial Sequence
  synthetic Reed-Solomon code for 8+2 base, 1 base error, 2 nocall correction
gtctaatgca

SEQ ID NO: 2824 - DNA, 10 bp, Artificial Sequence
  synthetic Reed-Solomon code for 8+2 base, 1 base error, 2 nocall correction
cattaatggt

SEQ ID NO: 2825 - DNA, 10 bp, Artificial Sequence
  synthetic Reed-Solomon code for 8+2 base, 1 base error, 2 nocall correction
caaacatgct

SEQ ID NO: 2826 - DNA, 10 bp, Artificial Sequence
  synthetic Reed-Solomon code for 8+2 base, 1 base error, 2 nocall correction
catacatgag

SEQ ID NO: 2827 - DNA, 10 bp, Artificial Sequence
  synthetic Reed-Solomon code for 8+2 base, 1 base error, 2 nocall correction
cccccatgat

SEQ ID NO: 2828 - DNA, 10 bp, Artificial Sequence
  synthetic Reed-Solomon code for 8+2 base, 1 base error, 2 nocall correction
tctccatgac

SEQ ID NO: 2829 - DNA, 10 bp, Artificial Sequence
  synthetic Reed-Solomon code for 8+2 base, 1 base error, 2 nocall correction
aaagcatgcc

SEQ ID NO: 2830 - DNA, 10 bp, Artificial Sequence
  synthetic Reed-Solomon code for 8+2 base, 1 base error, 2 nocall correction
cacgcatgca

SEQ ID NO: 2831 - DNA, 10 bp, Artificial Sequence
  synthetic Reed-Solomon code for 8+2 base, 1 base error, 2 nocall correction
ttggcatggg

SEQ ID NO: 2832 - DNA, 10 bp, Artificial Sequence
  synthetic Reed-Solomon code for 8+2 base, 1 base error, 2 nocall correction
gttgcatggt

SEQ ID NO: 2833 - DNA, 10 bp, Artificial Sequence
  synthetic Reed-Solomon code for 8+2 base, 1 base error, 2 nocall correction
ctatcatgtg

SEQ ID NO: 2834 - DNA, 10 bp, Artificial Sequence
  synthetic Reed-Solomon code for 8+2 base, 1 base error, 2 nocall correction
acctcatggg

SEQ ID NO: 2835 - DNA, 10 bp, Artificial Sequence
  synthetic Reed-Solomon code for 8+2 base, 1 base error, 2 nocall correction
gggtcatgtt

SEQ ID NO: 2836 - DNA, 10 bp, Artificial Sequence
  synthetic Reed-Solomon code for 8+2 base, 1 base error, 2 nocall correction
tgttcatgtg

SEQ ID NO: 2837 - DNA, 10 bp, Artificial Sequence
  synthetic Reed-Solomon code for 8+2 base, 1 base error, 2 nocall correction
aaaagatgtg

SEQ ID NO: 2838 - DNA, 10 bp, Artificial Sequence
  synthetic Reed-Solomon code for 8+2 base, 1 base error, 2 nocall correction
gcaagatgaa

SEQ ID NO: 2839 - DNA, 10 bp, Artificial Sequence
  synthetic Reed-Solomon code for 8+2 base, 1 base error, 2 nocall correction
gagagatgta

SEQ ID NO: 2840 - DNA, 10 bp, Artificial Sequence
  synthetic Reed-Solomon code for 8+2 base, 1 base error, 2 nocall correction
acgagatgag

SEQ ID NO: 2841 - DNA, 10 bp, Artificial Sequence
  synthetic Reed-Solomon code for 8+2 base, 1 base error, 2 nocall correction
tcgagatgca

SEQ ID NO: 2842 - DNA, 10 bp, Artificial Sequence
  synthetic Reed-Solomon code for 8+2 base, 1 base error, 2 nocall correction
tgacgatggt

SEQ ID NO: 2843 - DNA, 10 bp, Artificial Sequence
  synthetic Reed-Solomon code for 8+2 base, 1 base error, 2 nocall correction
gaccgatgca

SEQ ID NO: 2844 - DNA, 10 bp, Artificial Sequence
  synthetic Reed-Solomon code for 8+2 base, 1 base error, 2 nocall correction
tcccgatgta

SEQ ID NO: 2845 - DNA, 10 bp, Artificial Sequence
  synthetic Reed-Solomon code for 8+2 base, 1 base error, 2 nocall correction
ttccgatggc

SEQ ID NO: 2846 - DNA, 10 bp, Artificial Sequence
  synthetic Reed-Solomon code for 8+2 base, 1 base error, 2 nocall correction
agtcgatgga

SEQ ID NO: 2847 - DNA, 10 bp, Artificial Sequence
  synthetic Reed-Solomon code for 8+2 base, 1 base error, 2 nocall correction
cttcgatggt

SEQ ID NO: 2848 - DNA, 10 bp, Artificial Sequence
  synthetic Reed-Solomon code for 8+2 base, 1 base error, 2 nocall correction
gccggatgat

SEQ ID NO: 2849 - DNA, 10 bp, Artificial Sequence
  synthetic Reed-Solomon code for 8+2 base, 1 base error, 2 nocall correction
cgatgatgca

SEQ ID NO: 2850 - DNA, 10 bp, Artificial Sequence
  synthetic Reed-Solomon code for 8+2 base, 1 base error, 2 nocall correction
atatgatgct

SEQ ID NO: 2851 - DNA, 10 bp, Artificial Sequence
  synthetic Reed-Solomon code for 8+2 base, 1 base error, 2 nocall correction
agctgatgcc

SEQ ID NO: 2852 - DNA, 10 bp, Artificial Sequence
  synthetic Reed-Solomon code for 8+2 base, 1 base error, 2 nocall correction
gattgatggc

SEQ ID NO: 2853 - DNA, 10 bp, Artificial Sequence
  synthetic Reed-Solomon code for 8+2 base, 1 base error, 2 nocall correction
atttgatgag

SEQ ID NO: 2854 - DNA, 10 bp, Artificial Sequence
  synthetic Reed-Solomon code for 8+2 base, 1 base error, 2 nocall correction
ttttgatgca

SEQ ID NO: 2855 - DNA, 10 bp, Artificial Sequence
  synthetic Reed-Solomon code for 8+2 base, 1 base error, 2 nocall correction
caaatatgga

SEQ ID NO: 2856 - DNA, 10 bp, Artificial Sequence
  synthetic Reed-Solomon code for 8+2 base, 1 base error, 2 nocall correction
aacatatggc

SEQ ID NO: 2857 - DNA, 10 bp, Artificial Sequence
  synthetic Reed-Solomon code for 8+2 base, 1 base error, 2 nocall correction
gtcatatgag

SEQ ID NO: 2858 - DNA, 10 bp, Artificial Sequence
  synthetic Reed-Solomon code for 8+2 base, 1 base error, 2 nocall correction
ctgatatgac

SEQ ID NO: 2859 - DNA, 10 bp, Artificial Sequence
  synthetic Reed-Solomon code for 8+2 base, 1 base error, 2 nocall correction
ggtatatgcc

SEQ ID NO: 2860 - DNA, 10 bp, Artificial Sequence
  synthetic Reed-Solomon code for 8+2 base, 1 base error, 2 nocall correction
ttactatgtg

SEQ ID NO: 2861 - DNA, 10 bp, Artificial Sequence
  synthetic Reed-Solomon code for 8+2 base, 1 base error, 2 nocall correction
cgtctatgtg

SEQ ID NO: 2862 - DNA, 10 bp, Artificial Sequence
  synthetic Reed-Solomon code for 8+2 base, 1 base error, 2 nocall correction
cacgtatggt

SEQ ID NO: 2863 - DNA, 10 bp, Artificial Sequence
  synthetic Reed-Solomon code for 8+2 base, 1 base error, 2 nocall correction
cgggtatgaa

SEQ ID NO: 2864 - DNA, 10 bp, Artificial Sequence
  synthetic Reed-Solomon code for 8+2 base, 1 base error, 2 nocall correction
atggtatgat

SEQ ID NO: 2865 - DNA, 10 bp, Artificial Sequence
  synthetic Reed-Solomon code for 8+2 base, 1 base error, 2 nocall correction
tatgtatggc

SEQ ID NO: 2866 - DNA, 10 bp, Artificial Sequence
  synthetic Reed-Solomon code for 8+2 base, 1 base error, 2 nocall correction
gttgtatgca

SEQ ID NO: 2867 - DNA, 10 bp, Artificial Sequence
  synthetic Reed-Solomon code for 8+2 base, 1 base error, 2 nocall correction
tccttatgat

SEQ ID NO: 2868 - DNA, 10 bp, Artificial Sequence
  synthetic Reed-Solomon code for 8+2 base, 1 base error, 2 nocall correction
cctttatgac

SEQ ID NO: 2869 - DNA, 10 bp, Artificial Sequence
  synthetic Reed-Solomon code for 8+2 base, 1 base error, 2 nocall correction
ccaaactgct

SEQ ID NO: 2870 - DNA, 10 bp, Artificial Sequence
  synthetic Reed-Solomon code for 8+2 base, 1 base error, 2 nocall correction
cctaactgag

SEQ ID NO: 2871 - DNA, 10 bp, Artificial Sequence
  synthetic Reed-Solomon code for 8+2 base, 1 base error, 2 nocall correction
caccactgat

SEQ ID NO: 2872 - DNA, 10 bp, Artificial Sequence
  synthetic Reed-Solomon code for 8+2 base, 1 base error, 2 nocall correction
cggcactgga

SEQ ID NO: 2873 - DNA, 10 bp, Artificial Sequence
  synthetic Reed-Solomon code for 8+2 base, 1 base error, 2 nocall correction
atgcactggt

SEQ ID NO: 2874 - DNA, 10 bp, Artificial Sequence
  synthetic Reed-Solomon code for 8+2 base, 1 base error, 2 nocall correction
tatcactgac

SEQ ID NO: 2875 - DNA, 10 bp, Artificial Sequence
  synthetic Reed-Solomon code for 8+2 base, 1 base error, 2 nocall correction
acagactgcc

SEQ ID NO: 2876 - DNA, 10 bp, Artificial Sequence
  synthetic Reed-Solomon code for 8+2 base, 1 base error, 2 nocall correction
cccgactgca

SEQ ID NO: 2877 - DNA, 10 bp, Artificial Sequence
  synthetic Reed-Solomon code for 8+2 base, 1 base error, 2 nocall correction
ggatactgat

SEQ ID NO: 2878 - DNA, 10 bp, Artificial Sequence
  synthetic Reed-Solomon code for 8+2 base, 1 base error, 2 nocall correction
aactactggg

SEQ ID NO: 2879 - DNA, 10 bp, Artificial Sequence
  synthetic Reed-Solomon code for 8+2 base, 1 base error, 2 nocall correction
gtctactgac

SEQ ID NO: 2880 - DNA, 10 bp, Artificial Sequence
  synthetic Reed-Solomon code for 8+2 base, 1 base error, 2 nocall correction
tggtactgct

SEQ ID NO: 2881 - DNA, 10 bp, Artificial Sequence
  synthetic Reed-Solomon code for 8+2 base, 1 base error, 2 nocall correction
ctgtactgag

SEQ ID NO: 2882 - DNA, 10 bp, Artificial Sequence
  synthetic Reed-Solomon code for 8+2 base, 1 base error, 2 nocall correction
ggttactgcg

SEQ ID NO: 2883 - DNA, 10 bp, Artificial Sequence
  synthetic Reed-Solomon code for 8+2 base, 1 base error, 2 nocall correction
ggaacctggg

SEQ ID NO: 2884 - DNA, 10 bp, Artificial Sequence
  synthetic Reed-Solomon code for 8+2 base, 1 base error, 2 nocall correction
aacacctgat

SEQ ID NO: 2885 - DNA, 10 bp, Artificial Sequence
  synthetic Reed-Solomon code for 8+2 base, 1 base error, 2 nocall correction
aggacctgga

SEQ ID NO: 2886 - DNA, 10 bp, Artificial Sequence
  synthetic Reed-Solomon code for 8+2 base, 1 base error, 2 nocall correction
ctgacctggt

SEQ ID NO: 2887 - DNA, 10 bp, Artificial Sequence
  synthetic Reed-Solomon code for 8+2 base, 1 base error, 2 nocall correction
acaccctgct

SEQ ID NO: 2888 - DNA, 10 bp, Artificial Sequence
  synthetic Reed-Solomon code for 8+2 base, 1 base error, 2 nocall correction
gatccctgta

SEQ ID NO: 2889 - DNA, 10 bp, Artificial Sequence
  synthetic Reed-Solomon code for 8+2 base, 1 base error, 2 nocall correction
actccctgag

SEQ ID NO: 2890 - DNA, 10 bp, Artificial Sequence
  synthetic Reed-Solomon code for 8+2 base, 1 base error, 2 nocall correction
tctccctgca

SEQ ID NO: 2891 - DNA, 10 bp, Artificial Sequence
  synthetic Reed-Solomon code for 8+2 base, 1 base error, 2 nocall correction
aaagcctgaa

SEQ ID NO: 2892 - DNA, 10 bp, Artificial Sequence
  synthetic Reed-Solomon code for 8+2 base, 1 base error, 2 nocall correction
taagcctgcg

SEQ ID NO: 2893 - DNA, 10 bp, Artificial Sequence
  synthetic Reed-Solomon code for 8+2 base, 1 base error, 2 nocall correction
gcagcctgtg

SEQ ID NO: 2894 - DNA, 10 bp, Artificial Sequence
  synthetic Reed-Solomon code for 8+2 base, 1 base error, 2 nocall correction
cacgcctgac

SEQ ID NO: 2895 - DNA, 10 bp, Artificial Sequence
  synthetic Reed-Solomon code for 8+2 base, 1 base error, 2 nocall correction
gaggcctgag

SEQ ID NO: 2896 - DNA, 10 bp, Artificial Sequence
  synthetic Reed-Solomon code for 8+2 base, 1 base error, 2 nocall correction
acggcctgta

SEQ ID NO: 2897 - DNA, 10 bp, Artificial Sequence
  synthetic Reed-Solomon code for 8+2 base, 1 base error, 2 nocall correction
atggcctggc

SEQ ID NO: 2898 - DNA, 10 bp, Artificial Sequence
  synthetic Reed-Solomon code for 8+2 base, 1 base error, 2 nocall correction
tatgcctgat

SEQ ID NO: 2899 - DNA, 10 bp, Artificial Sequence
  synthetic Reed-Solomon code for 8+2 base, 1 base error, 2 nocall correction
tcctcctggc

SEQ ID NO: 2900 - DNA, 10 bp, Artificial Sequence
  synthetic Reed-Solomon code for 8+2 base, 1 base error, 2 nocall correction
ttctcctgta

SEQ ID NO: 2901 - DNA, 10 bp, Artificial Sequence
  synthetic Reed-Solomon code for 8+2 base, 1 base error, 2 nocall correction
ccttcctggt

SEQ ID NO: 2902 - DNA, 10 bp, Artificial Sequence
  synthetic Reed-Solomon code for 8+2 base, 1 base error, 2 nocall correction
agttcctgtc

SEQ ID NO: 2903 - DNA, 10 bp, Artificial Sequence
  synthetic Reed-Solomon code for 8+2 base, 1 base error, 2 nocall correction
taaagctgtc

SEQ ID NO: 2904 - DNA, 10 bp, Artificial Sequence
  synthetic Reed-Solomon code for 8+2 base, 1 base error, 2 nocall correction
gcaagctgcc

SEQ ID NO: 2905 - DNA, 10 bp, Artificial Sequence
  synthetic Reed-Solomon code for 8+2 base, 1 base error, 2 nocall correction
tcgagctgac

SEQ ID NO: 2906 - DNA, 10 bp, Artificial Sequence
  synthetic Reed-Solomon code for 8+2 base, 1 base error, 2 nocall correction
ccacgctgtg

SEQ ID NO: 2907 - DNA, 10 bp, Artificial Sequence
  synthetic Reed-Solomon code for 8+2 base, 1 base error, 2 nocall correction
gaccgctgac

SEQ ID NO: 2908 - DNA, 10 bp, Artificial Sequence
  synthetic Reed-Solomon code for 8+2 base, 1 base error, 2 nocall correction
atccgctggg

SEQ ID NO: 2909 - DNA, 10 bp, Artificial Sequence
  synthetic Reed-Solomon code for 8+2 base, 1 base error, 2 nocall correction
cagcgctgag

SEQ ID NO: 2910 - DNA, 10 bp, Artificial Sequence
  synthetic Reed-Solomon code for 8+2 base, 1 base error, 2 nocall correction
catggctgta

SEQ ID NO: 2911 - DNA, 10 bp, Artificial Sequence
  synthetic Reed-Solomon code for 8+2 base, 1 base error, 2 nocall correction
cgatgctgac

SEQ ID NO: 2912 - DNA, 10 bp, Artificial Sequence
  synthetic Reed-Solomon code for 8+2 base, 1 base error, 2 nocall correction
agctgctgaa

SEQ ID NO: 2913 - DNA, 10 bp, Artificial Sequence
  synthetic Reed-Solomon code for 8+2 base, 1 base error, 2 nocall correction
tgctgctgcg

SEQ ID NO: 2914 - DNA, 10 bp, Artificial Sequence
  synthetic Reed-Solomon code for 8+2 base, 1 base error, 2 nocall correction
ctctgctgat

SEQ ID NO: 2915 - DNA, 10 bp, Artificial Sequence
  synthetic Reed-Solomon code for 8+2 base, 1 base error, 2 nocall correction
aagtgctggt

SEQ ID NO: 2916 - DNA, 10 bp, Artificial Sequence
  synthetic Reed-Solomon code for 8+2 base, 1 base error, 2 nocall correction
ttttgctgac

SEQ ID NO: 2917 - DNA, 10 bp, Artificial Sequence
  synthetic Reed-Solomon code for 8+2 base, 1 base error, 2 nocall correction
tacatctggg

SEQ ID NO: 2918 - DNA, 10 bp, Artificial Sequence
  synthetic Reed-Solomon code for 8+2 base, 1 base error, 2 nocall correction
aggatctgct

SEQ ID NO: 2919 - DNA, 10 bp, Artificial Sequence
  synthetic Reed-Solomon code for 8+2 base, 1 base error, 2 nocall correction
ctgatctgca

SEQ ID NO: 2920 - DNA, 10 bp, Artificial Sequence
  synthetic Reed-Solomon code for 8+2 base, 1 base error, 2 nocall correction
ggtatctgaa

SEQ ID NO: 2921 - DNA, 10 bp, Artificial Sequence
  synthetic Reed-Solomon code for 8+2 base, 1 base error, 2 nocall correction
acactctgga

SEQ ID NO: 2922 - DNA, 10 bp, Artificial Sequence
  synthetic Reed-Solomon code for 8+2 base, 1 base error, 2 nocall correction
atactctgtc

SEQ ID NO: 2923 - DNA, 10 bp, Artificial Sequence
  synthetic Reed-Solomon code for 8+2 base, 1 base error, 2 nocall correction
cccctctggc

SEQ ID NO: 2924 - DNA, 10 bp, Artificial Sequence
  synthetic Reed-Solomon code for 8+2 base, 1 base error, 2 nocall correction
agcctctgtt

SEQ ID NO: 2925 - DNA, 10 bp, Artificial Sequence
  synthetic Reed-Solomon code for 8+2 base, 1 base error, 2 nocall correction
ctcctctgta

SEQ ID NO: 2926 - DNA, 10 bp, Artificial Sequence
  synthetic Reed-Solomon code for 8+2 base, 1 base error, 2 nocall correction
gcgctctggg

SEQ ID NO: 2927 - DNA, 10 bp, Artificial Sequence
  synthetic Reed-Solomon code for 8+2 base, 1 base error, 2 nocall correction
tctctctggt

SEQ ID NO: 2928 - DNA, 10 bp, Artificial Sequence
  synthetic Reed-Solomon code for 8+2 base, 1 base error, 2 nocall correction
ggcgtctgcg

SEQ ID NO: 2929 - DNA, 10 bp, Artificial Sequence
  synthetic Reed-Solomon code for 8+2 base, 1 base error, 2 nocall correction
cgggtctgcc

SEQ ID NO: 2930 - DNA, 10 bp, Artificial Sequence
  synthetic Reed-Solomon code for 8+2 base, 1 base error, 2 nocall correction
aatgtctggg

SEQ ID NO: 2931 - DNA, 10 bp, Artificial Sequence
  synthetic Reed-Solomon code for 8+2 base, 1 base error, 2 nocall correction
gttgtctgac

SEQ ID NO: 2932 - DNA, 10 bp, Artificial Sequence
  synthetic Reed-Solomon code for 8+2 base, 1 base error, 2 nocall correction
cctttctgca

SEQ ID NO: 2933 - DNA, 10 bp, Artificial Sequence
  synthetic Reed-Solomon code for 8+2 base, 1 base error, 2 nocall correction
agaaagtgtg

SEQ ID NO: 2934 - DNA, 10 bp, Artificial Sequence
  synthetic Reed-Solomon code for 8+2 base, 1 base error, 2 nocall correction
gggaagtgta

SEQ ID NO: 2935 - DNA, 10 bp, Artificial Sequence
  synthetic Reed-Solomon code for 8+2 base, 1 base error, 2 nocall correction
taacagtggt

SEQ ID NO: 2936 - DNA, 10 bp, Artificial Sequence
  synthetic Reed-Solomon code for 8+2 base, 1 base error, 2 nocall correction
ggccagtgca

SEQ ID NO: 2937 - DNA, 10 bp, Artificial Sequence
  synthetic Reed-Solomon code for 8+2 base, 1 base error, 2 nocall correction
aatcagtgga

SEQ ID NO: 2938 - DNA, 10 bp, Artificial Sequence
  synthetic Reed-Solomon code for 8+2 base, 1 base error, 2 nocall correction
acagagtggg

SEQ ID NO: 2939 - DNA, 10 bp, Artificial Sequence
  synthetic Reed-Solomon code for 8+2 base, 1 base error, 2 nocall correction
ctcgagtgtg

SEQ ID NO: 2940 - DNA, 10 bp, Artificial Sequence
  synthetic Reed-Solomon code for 8+2 base, 1 base error, 2 nocall correction
gcggagtgga

SEQ ID NO: 2941 - DNA, 10 bp, Artificial Sequence
  synthetic Reed-Solomon code for 8+2 base, 1 base error, 2 nocall correction
gtggagtgtc

SEQ ID NO: 2942 - DNA, 10 bp, Artificial Sequence
  synthetic Reed-Solomon code for 8+2 base, 1 base error, 2 nocall correction
caatagtgca

SEQ ID NO: 2943 - DNA, 10 bp, Artificial Sequence
  synthetic Reed-Solomon code for 8+2 base, 1 base error, 2 nocall correction
aactagtgcc

SEQ ID NO: 2944 - DNA, 10 bp, Artificial Sequence
  synthetic Reed-Solomon code for 8+2 base, 1 base error, 2 nocall correction
ggttagtggc

SEQ ID NO: 2945 - DNA, 10 bp, Artificial Sequence
  synthetic Reed-Solomon code for 8+2 base, 1 base error, 2 nocall correction
ggaacgtgcc

SEQ ID NO: 2946 - DNA, 10 bp, Artificial Sequence
  synthetic Reed-Solomon code for 8+2 base, 1 base error, 2 nocall correction
gtcacgtgct

SEQ ID NO: 2947 - DNA, 10 bp, Artificial Sequence
  synthetic Reed-Solomon code for 8+2 base, 1 base error, 2 nocall correction
tggacgtgac

SEQ ID NO: 2948 - DNA, 10 bp, Artificial Sequence
  synthetic Reed-Solomon code for 8+2 base, 1 base error, 2 nocall correction
catacgtgga

SEQ ID NO: 2949 - DNA, 10 bp, Artificial Sequence
  synthetic Reed-Solomon code for 8+2 base, 1 base error, 2 nocall correction
cgaccgtgtg

SEQ ID NO: 2950 - DNA, 10 bp, Artificial Sequence
  synthetic Reed-Solomon code for 8+2 base, 1 base error, 2 nocall correction
gtgccgtgtt

SEQ ID NO: 2951 - DNA, 10 bp, Artificial Sequence
  synthetic Reed-Solomon code for 8+2 base, 1 base error, 2 nocall correction
tttccgtgtg

SEQ ID NO: 2952 - DNA, 10 bp, Artificial Sequence
  synthetic Reed-Solomon code for 8+2 base, 1 base error, 2 nocall correction
taagcgtggc

SEQ ID NO: 2953 - DNA, 10 bp, Artificial Sequence
  synthetic Reed-Solomon code for 8+2 base, 1 base error, 2 nocall correction
gtagcgtgca

SEQ ID NO: 2954 - DNA, 10 bp, Artificial Sequence
  synthetic Reed-Solomon code for 8+2 base, 1 base error, 2 nocall correction
atggcgtgcg

SEQ ID NO: 2955 - DNA, 10 bp, Artificial Sequence
  synthetic Reed-Solomon code for 8+2 base, 1 base error, 2 nocall correction
ttggcgtgaa

SEQ ID NO: 2956 - DNA, 10 bp, Artificial Sequence
  synthetic Reed-Solomon code for 8+2 base, 1 base error, 2 nocall correction
ccatcgtgac

SEQ ID NO: 2957 - DNA, 10 bp, Artificial Sequence
  synthetic Reed-Solomon code for 8+2 base, 1 base error, 2 nocall correction
gactcgtgtg

SEQ ID NO: 2958 - DNA, 10 bp, Artificial Sequence
  synthetic Reed-Solomon code for 8+2 base, 1 base error, 2 nocall correction
acctcgtgaa

SEQ ID NO: 2959 - DNA, 10 bp, Artificial Sequence
  synthetic Reed-Solomon code for 8+2 base, 1 base error, 2 nocall correction
tcctcgtgcg

SEQ ID NO: 2960 - DNA, 10 bp, Artificial Sequence
  synthetic Reed-Solomon code for 8+2 base, 1 base error, 2 nocall correction
cagtcgtgtc

SEQ ID NO: 2961 - DNA, 10 bp, Artificial Sequence
  synthetic Reed-Solomon code for 8+2 base, 1 base error, 2 nocall correction
gcaaggtggg

SEQ ID NO: 2962 - DNA, 10 bp, Artificial Sequence
  synthetic Reed-Solomon code for 8+2 base, 1 base error, 2 nocall correction
acgaggtgga

SEQ ID NO: 2963 - DNA, 10 bp, Artificial Sequence
  synthetic Reed-Solomon code for 8+2 base, 1 base error, 2 nocall correction
atgaggtgtc

SEQ ID NO: 2964 - DNA, 10 bp, Artificial Sequence
  synthetic Reed-Solomon code for 8+2 base, 1 base error, 2 nocall correction
agacggtgct

SEQ ID NO: 2965 - DNA, 10 bp, Artificial Sequence
  synthetic Reed-Solomon code for 8+2 base, 1 base error, 2 nocall correction
ctacggtgca

SEQ ID NO: 2966 - DNA, 10 bp, Artificial Sequence
  synthetic Reed-Solomon code for 8+2 base, 1 base error, 2 nocall correction
atccggtgcc

SEQ ID NO: 2967 - DNA, 10 bp, Artificial Sequence
  synthetic Reed-Solomon code for 8+2 base, 1 base error, 2 nocall correction
agtcggtgag

SEQ ID NO: 2968 - DNA, 10 bp, Artificial Sequence
  synthetic Reed-Solomon code for 8+2 base, 1 base error, 2 nocall correction
tgtcggtgca

SEQ ID NO: 2969 - DNA, 10 bp, Artificial Sequence
  synthetic Reed-Solomon code for 8+2 base, 1 base error, 2 nocall correction
ggagggtgtg

SEQ ID NO: 2970 - DNA, 10 bp, Artificial Sequence
  synthetic Reed-Solomon code for 8+2 base, 1 base error, 2 nocall correction
agggggtgta

SEQ ID NO: 2971 - DNA, 10 bp, Artificial Sequence
  synthetic Reed-Solomon code for 8+2 base, 1 base error, 2 nocall correction
ctggggtgtt

SEQ ID NO: 2972 - DNA, 10 bp, Artificial Sequence
  synthetic Reed-Solomon code for 8+2 base, 1 base error, 2 nocall correction
ttatggtggt

SEQ ID NO: 2973 - DNA, 10 bp, Artificial Sequence
  synthetic Reed-Solomon code for 8+2 base, 1 base error, 2 nocall correction
tgctggtggc

SEQ ID NO: 2974 - DNA, 10 bp, Artificial Sequence
  synthetic Reed-Solomon code for 8+2 base, 1 base error, 2 nocall correction
acttggtgtc

SEQ ID NO: 2975 - DNA, 10 bp, Artificial Sequence
  synthetic Reed-Solomon code for 8+2 base, 1 base error, 2 nocall correction
cgttggtggt

SEQ ID NO: 2976 - DNA, 10 bp, Artificial Sequence
  synthetic Reed-Solomon code for 8+2 base, 1 base error, 2 nocall correction
atttggtgga

SEQ ID NO: 2977 - DNA, 10 bp, Artificial Sequence
  synthetic Reed-Solomon code for 8+2 base, 1 base error, 2 nocall correction
caaatgtgag

SEQ ID NO: 2978 - DNA, 10 bp, Artificial Sequence
  synthetic Reed-Solomon code for 8+2 base, 1 base error, 2 nocall correction
tacatgtgcc

SEQ ID NO: 2979 - DNA, 10 bp, Artificial Sequence
  synthetic Reed-Solomon code for 8+2 base, 1 base error, 2 nocall correction
gccatgtgtc

SEQ ID NO: 2980 - DNA, 10 bp, Artificial Sequence
  synthetic Reed-Solomon code for 8+2 base, 1 base error, 2 nocall correction
gtcatgtgga

SEQ ID NO: 2981 - DNA, 10 bp, Artificial Sequence
  synthetic Reed-Solomon code for 8+2 base, 1 base error, 2 nocall correction
ccgatgtgtg

SEQ ID NO: 2982 - DNA, 10 bp, Artificial Sequence
  synthetic Reed-Solomon code for 8+2 base, 1 base error, 2 nocall correction
catatgtgct

SEQ ID NO: 2983 - DNA, 10 bp, Artificial Sequence
  synthetic Reed-Solomon code for 8+2 base, 1 base error, 2 nocall correction
tcactgtgac

SEQ ID NO: 2984 - DNA, 10 bp, Artificial Sequence
  synthetic Reed-Solomon code for 8+2 base, 1 base error, 2 nocall correction
cccctgtgcg

SEQ ID NO: 2985 - DNA, 10 bp, Artificial Sequence
  synthetic Reed-Solomon code for 8+2 base, 1 base error, 2 nocall correction
tagctgtgtc

SEQ ID NO: 2986 - DNA, 10 bp, Artificial Sequence
  synthetic Reed-Solomon code for 8+2 base, 1 base error, 2 nocall correction
gcgctgtgcc

SEQ ID NO: 2987 - DNA, 10 bp, Artificial Sequence
  synthetic Reed-Solomon code for 8+2 base, 1 base error, 2 nocall correction
gtagtgtggt

SEQ ID NO: 2988 - DNA, 10 bp, Artificial Sequence
  synthetic Reed-Solomon code for 8+2 base, 1 base error, 2 nocall correction
ggcgtgtggc

SEQ ID NO: 2989 - DNA, 10 bp, Artificial Sequence
  synthetic Reed-Solomon code for 8+2 base, 1 base error, 2 nocall correction
cgggtgtggg

SEQ ID NO: 2990 - DNA, 10 bp, Artificial Sequence
  synthetic Reed-Solomon code for 8+2 base, 1 base error, 2 nocall correction
aatgtgtgcc

SEQ ID NO: 2991 - DNA, 10 bp, Artificial Sequence
  synthetic Reed-Solomon code for 8+2 base, 1 base error, 2 nocall correction
tgattgtgtg

SEQ ID NO: 2992 - DNA, 10 bp, Artificial Sequence
  synthetic Reed-Solomon code for 8+2 base, 1 base error, 2 nocall correction
cttttgtgtg

SEQ ID NO: 2993 - DNA, 10 bp, Artificial Sequence
  synthetic Reed-Solomon code for 8+2 base, 1 base error, 2 nocall correction
ccaaattgtc

SEQ ID NO: 2994 - DNA, 10 bp, Artificial Sequence
  synthetic Reed-Solomon code for 8+2 base, 1 base error, 2 nocall correction
agaaattggt

SEQ ID NO: 2995 - DNA, 10 bp, Artificial Sequence
  synthetic Reed-Solomon code for 8+2 base, 1 base error, 2 nocall correction
ctaaattgga

SEQ ID NO: 2996 - DNA, 10 bp, Artificial Sequence
  synthetic Reed-Solomon code for 8+2 base, 1 base error, 2 nocall correction
gacaattgag

SEQ ID NO: 2997 - DNA, 10 bp, Artificial Sequence
  synthetic Reed-Solomon code for 8+2 base, 1 base error, 2 nocall correction
accaattgta

SEQ ID NO: 2998 - DNA, 10 bp, Artificial Sequence
  synthetic Reed-Solomon code for 8+2 base, 1 base error, 2 nocall correction
atcaattggc

SEQ ID NO: 2999 - DNA, 10 bp, Artificial Sequence
  synthetic Reed-Solomon code for 8+2 base, 1 base error, 2 nocall correction
cagaattgac

SEQ ID NO: 3000 - DNA, 10 bp, Artificial Sequence
  synthetic Reed-Solomon code for 8+2 base, 1 base error, 2 nocall correction
tgtaattgga

SEQ ID NO: 3001 - DNA, 10 bp, Artificial Sequence
  synthetic Reed-Solomon code for 8+2 base, 1 base error, 2 nocall correction
taacattgtg

SEQ ID NO: 3002 - DNA, 10 bp, Artificial Sequence
  synthetic Reed-Solomon code for 8+2 base, 1 base error, 2 nocall correction
gcacattgcg

SEQ ID NO: 3003 - DNA, 10 bp, Artificial Sequence
  synthetic Reed-Solomon code for 8+2 base, 1 base error, 2 nocall correction
acgcattgca

SEQ ID NO: 3004 - DNA, 10 bp, Artificial Sequence
  synthetic Reed-Solomon code for 8+2 base, 1 base error, 2 nocall correction
tcgcattgag

SEQ ID NO: 3005 - DNA, 10 bp, Artificial Sequence
  synthetic Reed-Solomon code for 8+2 base, 1 base error, 2 nocall correction
gctcattgat

SEQ ID NO: 3006 - DNA, 10 bp, Artificial Sequence
  synthetic Reed-Solomon code for 8+2 base, 1 base error, 2 nocall correction
acagattgtt

SEQ ID NO: 3007 - DNA, 10 bp, Artificial Sequence
  synthetic Reed-Solomon code for 8+2 base, 1 base error, 2 nocall correction
cgagattggc

SEQ ID NO: 3008 - DNA, 10 bp, Artificial Sequence
  synthetic Reed-Solomon code for 8+2 base, 1 base error, 2 nocall correction
agcgattgga

SEQ ID NO: 3009 - DNA, 10 bp, Artificial Sequence
  synthetic Reed-Solomon code for 8+2 base, 1 base error, 2 nocall correction
ctcgattggt

SEQ ID NO: 3010 - DNA, 10 bp, Artificial Sequence
  synthetic Reed-Solomon code for 8+2 base, 1 base error, 2 nocall correction
aaggattgat

SEQ ID NO: 3011 - DNA, 10 bp, Artificial Sequence
  synthetic Reed-Solomon code for 8+2 base, 1 base error, 2 nocall correction
gatgattgca

SEQ ID NO: 3012 - DNA, 10 bp, Artificial Sequence
  synthetic Reed-Solomon code for 8+2 base, 1 base error, 2 nocall correction
tctgattgta

SEQ ID NO: 3013 - DNA, 10 bp, Artificial Sequence
  synthetic Reed-Solomon code for 8+2 base, 1 base error, 2 nocall correction
tttgattggc

SEQ ID NO: 3014 - DNA, 10 bp, Artificial Sequence
  synthetic Reed-Solomon code for 8+2 base, 1 base error, 2 nocall correction
tggtattgtc

SEQ ID NO: 3015 - DNA, 10 bp, Artificial Sequence
  synthetic Reed-Solomon code for 8+2 base, 1 base error, 2 nocall correction
ccgacttgca

SEQ ID NO: 3016 - DNA, 10 bp, Artificial Sequence
  synthetic Reed-Solomon code for 8+2 base, 1 base error, 2 nocall correction
acaccttgtc

SEQ ID NO: 3017 - DNA, 10 bp, Artificial Sequence
  synthetic Reed-Solomon code for 8+2 base, 1 base error, 2 nocall correction
cgaccttggt

SEQ ID NO: 3018 - DNA, 10 bp, Artificial Sequence
  synthetic Reed-Solomon code for 8+2 base, 1 base error, 2 nocall correction
ataccttgga

SEQ ID NO: 3019 - DNA, 10 bp, Artificial Sequence
  synthetic Reed-Solomon code for 8+2 base, 1 base error, 2 nocall correction
cccccttgta

SEQ ID NO: 3020 - DNA, 10 bp, Artificial Sequence
  synthetic Reed-Solomon code for 8+2 base, 1 base error, 2 nocall correction
ctcccttggc

SEQ ID NO: 3021 - DNA, 10 bp, Artificial Sequence
  synthetic Reed-Solomon code for 8+2 base, 1 base error, 2 nocall correction
aagccttgac

SEQ ID NO: 3022 - DNA, 10 bp, Artificial Sequence
  synthetic Reed-Solomon code for 8+2 base, 1 base error, 2 nocall correction
gtgccttggg

SEQ ID NO: 3023 - DNA, 10 bp, Artificial Sequence
  synthetic Reed-Solomon code for 8+2 base, 1 base error, 2 nocall correction
tttccttggt

SEQ ID NO: 3024 - DNA, 10 bp, Artificial Sequence
  synthetic Reed-Solomon code for 8+2 base, 1 base error, 2 nocall correction
gctgcttgac

SEQ ID NO: 3025 - DNA, 10 bp, Artificial Sequence
  synthetic Reed-Solomon code for 8+2 base, 1 base error, 2 nocall correction
agatcttgag

SEQ ID NO: 3026 - DNA, 10 bp, Artificial Sequence
  synthetic Reed-Solomon code for 8+2 base, 1 base error, 2 nocall correction
tgatcttgca

SEQ ID NO: 3027 - DNA, 10 bp, Artificial Sequence
  synthetic Reed-Solomon code for 8+2 base, 1 base error, 2 nocall correction
gactcttggt

SEQ ID NO: 3028 - DNA, 10 bp, Artificial Sequence
  synthetic Reed-Solomon code for 8+2 base, 1 base error, 2 nocall correction
gggtcttgaa

SEQ ID NO: 3029 - DNA, 10 bp, Artificial Sequence
  synthetic Reed-Solomon code for 8+2 base, 1 base error, 2 nocall correction
agttcttgct

SEQ ID NO: 3030 - DNA, 10 bp, Artificial Sequence
  synthetic Reed-Solomon code for 8+2 base, 1 base error, 2 nocall correction
ctttcttgca

SEQ ID NO: 3031 - DNA, 10 bp, Artificial Sequence
  synthetic Reed-Solomon code for 8+2 base, 1 base error, 2 nocall correction
taaagttgct

SEQ ID NO: 3032 - DNA, 10 bp, Artificial Sequence
  synthetic Reed-Solomon code for 8+2 base, 1 base error, 2 nocall correction
gcaagttgtt

SEQ ID NO: 3033 - DNA, 10 bp, Artificial Sequence
  synthetic Reed-Solomon code for 8+2 base, 1 base error, 2 nocall correction
ggcagttgga

SEQ ID NO: 3034 - DNA, 10 bp, Artificial Sequence
  synthetic Reed-Solomon code for 8+2 base, 1 base error, 2 nocall correction
gagagttgat

SEQ ID NO: 3035 - DNA, 10 bp, Artificial Sequence
  synthetic Reed-Solomon code for 8+2 base, 1 base error, 2 nocall correction
aatagttgca

SEQ ID NO: 3036 - DNA, 10 bp, Artificial Sequence
  synthetic Reed-Solomon code for 8+2 base, 1 base error, 2 nocall correction
tatagttgag

SEQ ID NO: 3037 - DNA, 10 bp, Artificial Sequence
  synthetic Reed-Solomon code for 8+2 base, 1 base error, 2 nocall correction
tcccgttgat

SEQ ID NO: 3038 - DNA, 10 bp, Artificial Sequence
  synthetic Reed-Solomon code for 8+2 base, 1 base error, 2 nocall correction
cctcgttgac

SEQ ID NO: 3039 - DNA, 10 bp, Artificial Sequence
  synthetic Reed-Solomon code for 8+2 base, 1 base error, 2 nocall correction
ggaggttggt

SEQ ID NO: 3040 - DNA, 10 bp, Artificial Sequence
  synthetic Reed-Solomon code for 8+2 base, 1 base error, 2 nocall correction
aacggttgag

SEQ ID NO: 3041 - DNA, 10 bp, Artificial Sequence
  synthetic Reed-Solomon code for 8+2 base, 1 base error, 2 nocall correction
tacggttgca

SEQ ID NO: 3042 - DNA, 10 bp, Artificial Sequence
  synthetic Reed-Solomon code for 8+2 base, 1 base error, 2 nocall correction
gccggttgta

SEQ ID NO: 3043 - DNA, 10 bp, Artificial Sequence
  synthetic Reed-Solomon code for 8+2 base, 1 base error, 2 nocall correction
gtcggttggc

SEQ ID NO: 3044 - DNA, 10 bp, Artificial Sequence
  synthetic Reed-Solomon code for 8+2 base, 1 base error, 2 nocall correction
ctgggttggg

SEQ ID NO: 3045 - DNA, 10 bp, Artificial Sequence
  synthetic Reed-Solomon code for 8+2 base, 1 base error, 2 nocall correction
ttatgttgtg

SEQ ID NO: 3046 - DNA, 10 bp, Artificial Sequence
  synthetic Reed-Solomon code for 8+2 base, 1 base error, 2 nocall correction
cgttgttgtg

SEQ ID NO: 3047 - DNA, 10 bp, Artificial Sequence
  synthetic Reed-Solomon code for 8+2 base, 1 base error, 2 nocall correction
ccgatttggt

SEQ ID NO: 3048 - DNA, 10 bp, Artificial Sequence
  synthetic Reed-Solomon code for 8+2 base, 1 base error, 2 nocall correction
aggatttgtc

SEQ ID NO: 3049 - DNA, 10 bp, Artificial Sequence
  synthetic Reed-Solomon code for 8+2 base, 1 base error, 2 nocall correction
cgactttgca

SEQ ID NO: 3050 - DNA, 10 bp, Artificial Sequence
  synthetic Reed-Solomon code for 8+2 base, 1 base error, 2 nocall correction
atactttgct

SEQ ID NO: 3051 - DNA, 10 bp, Artificial Sequence
  synthetic Reed-Solomon code for 8+2 base, 1 base error, 2 nocall correction
agcctttgcc

SEQ ID NO: 3052 - DNA, 10 bp, Artificial Sequence
  synthetic Reed-Solomon code for 8+2 base, 1 base error, 2 nocall correction
gatctttggc

SEQ ID NO: 3053 - DNA, 10 bp, Artificial Sequence
  synthetic Reed-Solomon code for 8+2 base, 1 base error, 2 nocall correction
attctttgag

SEQ ID NO: 3054 - DNA, 10 bp, Artificial Sequence
  synthetic Reed-Solomon code for 8+2 base, 1 base error, 2 nocall correction
tttctttgca

SEQ ID NO: 3055 - DNA, 10 bp, Artificial Sequence
  synthetic Reed-Solomon code for 8+2 base, 1 base error, 2 nocall correction
gtagtttgtg

SEQ ID NO: 3056 - DNA, 10 bp, Artificial Sequence
  synthetic Reed-Solomon code for 8+2 base, 1 base error, 2 nocall correction
acggtttggc

SEQ ID NO: 3057 - DNA, 10 bp, Artificial Sequence
  synthetic Reed-Solomon code for 8+2 base, 1 base error, 2 nocall correction
cgggtttgtt

SEQ ID NO: 3058 - DNA, 10 bp, Artificial Sequence
  synthetic Reed-Solomon code for 8+2 base, 1 base error, 2 nocall correction
atggtttgta

SEQ ID NO: 3059 - DNA, 10 bp, Artificial Sequence
  synthetic Reed-Solomon code for 8+2 base, 1 base error, 2 nocall correction
tgattttggt

SEQ ID NO: 3060 - DNA, 10 bp, Artificial Sequence
  synthetic Reed-Solomon code for 8+2 base, 1 base error, 2 nocall correction
gacttttgca

SEQ ID NO: 3061 - DNA, 10 bp, Artificial Sequence
  synthetic Reed-Solomon code for 8+2 base, 1 base error, 2 nocall correction
tccttttgta

SEQ ID NO: 3062 - DNA, 10 bp, Artificial Sequence
  synthetic Reed-Solomon code for 8+2 base, 1 base error, 2 nocall correction
ttcttttggc

SEQ ID NO: 3063 - DNA, 10 bp, Artificial Sequence
  synthetic Reed-Solomon code for 8+2 base, 1 base error, 2 nocall correction
agtttttgga

SEQ ID NO: 3064 - DNA, 10 bp, Artificial Sequence
  synthetic Reed-Solomon code for 8+2 base, 1 base error, 2 nocall correction
cttttttggt

SEQ ID NO: 3065 - DNA, 10 bp, Artificial Sequence
  synthetic Reed-Solomon code for 8+2 base, 1 base error, 2 nocall correction
gataaaatac

SEQ ID NO: 3066 - DNA, 10 bp, Artificial Sequence
  synthetic Reed-Solomon code for 8+2 base, 1 base error, 2 nocall correction
attaaaatgg

SEQ ID NO: 3067 - DNA, 10 bp, Artificial Sequence
  synthetic Reed-Solomon code for 8+2 base, 1 base error, 2 nocall correction
caacaaattt

SEQ ID NO: 3068 - DNA, 10 bp, Artificial Sequence
  synthetic Reed-Solomon code for 8+2 base, 1 base error, 2 nocall correction
ccgcaaatat

SEQ ID NO: 3069 - DNA, 10 bp, Artificial Sequence
  synthetic Reed-Solomon code for 8+2 base, 1 base error, 2 nocall correction
ttcgaaatgg

SEQ ID NO: 3070 - DNA, 10 bp, Artificial Sequence
  synthetic Reed-Solomon code for 8+2 base, 1 base error, 2 nocall correction
caggaaatca

SEQ ID NO: 3071 - DNA, 10 bp, Artificial Sequence
  synthetic Reed-Solomon code for 8+2 base, 1 base error, 2 nocall correction
gcataaatga

SEQ ID NO: 3072 - DNA, 10 bp, Artificial Sequence
  synthetic Reed-Solomon code for 8+2 base, 1 base error, 2 nocall correction
gtataaattc

SEQ ID NO: 3073 - DNA, 10 bp, Artificial Sequence
  synthetic Reed-Solomon code for 8+2 base, 1 base error, 2 nocall correction
ggctaaattt

SEQ ID NO: 3074 - DNA, 10 bp, Artificial Sequence
  synthetic Reed-Solomon code for 8+2 base, 1 base error, 2 nocall correction
acgtaaatgg

SEQ ID NO: 3075 - DNA, 10 bp, Artificial Sequence
  synthetic Reed-Solomon code for 8+2 base, 1 base error, 2 nocall correction
aaaacaattt

SEQ ID NO: 3076 - DNA, 10 bp, Artificial Sequence
  synthetic Reed-Solomon code for 8+2 base, 1 base error, 2 nocall correction
acgacaatat

SEQ ID NO: 3077 - DNA, 10 bp, Artificial Sequence
  synthetic Reed-Solomon code for 8+2 base, 1 base error, 2 nocall correction
tatacaatta

SEQ ID NO: 3078 - DNA, 10 bp, Artificial Sequence
  synthetic Reed-Solomon code for 8+2 base, 1 base error, 2 nocall correction
gctacaatca

SEQ ID NO: 3079 - DNA, 10 bp, Artificial Sequence
  synthetic Reed-Solomon code for 8+2 base, 1 base error, 2 nocall correction
tgaccaatgg

SEQ ID NO: 3080 - DNA, 10 bp, Artificial Sequence
  synthetic Reed-Solomon code for 8+2 base, 1 base error, 2 nocall correction
cttccaatgg

SEQ ID NO: 3081 - DNA, 10 bp, Artificial Sequence
  synthetic Reed-Solomon code for 8+2 base, 1 base error, 2 nocall correction
caagcaattc

SEQ ID NO: 3082 - DNA, 10 bp, Artificial Sequence
  synthetic Reed-Solomon code for 8+2 base, 1 base error, 2 nocall correction
aacgcaatta

SEQ ID NO: 3083 - DNA, 10 bp, Artificial Sequence
  synthetic Reed-Solomon code for 8+2 base, 1 base error, 2 nocall correction
gccgcaatag

SEQ ID NO: 3084 - DNA, 10 bp, Artificial Sequence
  synthetic Reed-Solomon code for 8+2 base, 1 base error, 2 nocall correction
ccggcaatac

SEQ ID NO: 3085 - DNA, 10 bp, Artificial Sequence
  synthetic Reed-Solomon code for 8+2 base, 1 base error, 2 nocall correction
atatcaatcg

SEQ ID NO: 3086 - DNA, 10 bp, Artificial Sequence
  synthetic Reed-Solomon code for 8+2 base, 1 base error, 2 nocall correction
ttatcaataa

SEQ ID NO: 3087 - DNA, 10 bp, Artificial Sequence
  synthetic Reed-Solomon code for 8+2 base, 1 base error, 2 nocall correction
tagtcaatgc

SEQ ID NO: 3088 - DNA, 10 bp, Artificial Sequence
  synthetic Reed-Solomon code for 8+2 base, 1 base error, 2 nocall correction
gtgtcaatca

SEQ ID NO: 3089 - DNA, 10 bp, Artificial Sequence
  synthetic Reed-Solomon code for 8+2 base, 1 base error, 2 nocall correction
cgttcaataa

SEQ ID NO: 3090 - DNA, 10 bp, Artificial Sequence
  synthetic Reed-Solomon code for 8+2 base, 1 base error, 2 nocall correction
atttcaatat

SEQ ID NO: 3091 - DNA, 10 bp, Artificial Sequence
  synthetic Reed-Solomon code for 8+2 base, 1 base error, 2 nocall correction
caaagaatcg

SEQ ID NO: 3092 - DNA, 10 bp, Artificial Sequence
  synthetic Reed-Solomon code for 8+2 base, 1 base error, 2 nocall correction
tacagaatac

SEQ ID NO: 3093 - DNA, 10 bp, Artificial Sequence
  synthetic Reed-Solomon code for 8+2 base, 1 base error, 2 nocall correction
catagaatat

SEQ ID NO: 3094 - DNA, 10 bp, Artificial Sequence
  synthetic Reed-Solomon code for 8+2 base, 1 base error, 2 nocall correction
gaacgaattc

SEQ ID NO: 3095 - DNA, 10 bp, Artificial Sequence
  synthetic Reed-Solomon code for 8+2 base, 1 base error, 2 nocall correction
tcacgaatcc

SEQ ID NO: 3096 - DNA, 10 bp, Artificial Sequence
  synthetic Reed-Solomon code for 8+2 base, 1 base error, 2 nocall correction
ccccgaatag

SEQ ID NO: 3097 - DNA, 10 bp, Artificial Sequence
  synthetic Reed-Solomon code for 8+2 base, 1 base error, 2 nocall correction
gcgcgaatac

SEQ ID NO: 3098 - DNA, 10 bp, Artificial Sequence
  synthetic Reed-Solomon code for 8+2 base, 1 base error, 2 nocall correction
ttgggaatgt

SEQ ID NO: 3099 - DNA, 10 bp, Artificial Sequence
  synthetic Reed-Solomon code for 8+2 base, 1 base error, 2 nocall correction
aatggaatac

SEQ ID NO: 3100 - DNA, 10 bp, Artificial Sequence
  synthetic Reed-Solomon code for 8+2 base, 1 base error, 2 nocall correction
gttggaatgg

SEQ ID NO: 3101 - DNA, 10 bp, Artificial Sequence
  synthetic Reed-Solomon code for 8+2 base, 1 base error, 2 nocall correction
agatgaatta

SEQ ID NO: 3102 - DNA, 10 bp, Artificial Sequence
  synthetic Reed-Solomon code for 8+2 base, 1 base error, 2 nocall correction
ctatgaattt

SEQ ID NO: 3103 - DNA, 10 bp, Artificial Sequence
  synthetic Reed-Solomon code for 8+2 base, 1 base error, 2 nocall correction
acctgaatgt

SEQ ID NO: 3104 - DNA, 10 bp, Artificial Sequence
  synthetic Reed-Solomon code for 8+2 base, 1 base error, 2 nocall correction
cgctgaattc

SEQ ID NO: 3105 - DNA, 10 bp, Artificial Sequence
  synthetic Reed-Solomon code for 8+2 base, 1 base error, 2 nocall correction
gggtgaattg

SEQ ID NO: 3106 - DNA, 10 bp, Artificial Sequence
  synthetic Reed-Solomon code for 8+2 base, 1 base error, 2 nocall correction
tgttgaattt

SEQ ID NO: 3107 - DNA, 10 bp, Artificial Sequence
  synthetic Reed-Solomon code for 8+2 base, 1 base error, 2 nocall correction
tcgataatgg

SEQ ID NO: 3108 - DNA, 10 bp, Artificial Sequence
  synthetic Reed-Solomon code for 8+2 base, 1 base error, 2 nocall correction
gctataatgt

SEQ ID NO: 3109 - DNA, 10 bp, Artificial Sequence
  synthetic Reed-Solomon code for 8+2 base, 1 base error, 2 nocall correction
agactaatat

SEQ ID NO: 3110 - DNA, 10 bp, Artificial Sequence
  synthetic Reed-Solomon code for 8+2 base, 1 base error, 2 nocall correction
ctactaataa

SEQ ID NO: 3111 - DNA, 10 bp, Artificial Sequence
  synthetic Reed-Solomon code for 8+2 base, 1 base error, 2 nocall correction
gacctaatgg

SEQ ID NO: 3112 - DNA, 10 bp, Artificial Sequence
  synthetic Reed-Solomon code for 8+2 base, 1 base error, 2 nocall correction
atcctaatac

SEQ ID NO: 3113 - DNA, 10 bp, Artificial Sequence
  synthetic Reed-Solomon code for 8+2 base, 1 base error, 2 nocall correction
cagctaatgc

SEQ ID NO: 3114 - DNA, 10 bp, Artificial Sequence
  synthetic Reed-Solomon code for 8+2 base, 1 base error, 2 nocall correction
agtctaatcg

SEQ ID NO: 3115 - DNA, 10 bp, Artificial Sequence
  synthetic Reed-Solomon code for 8+2 base, 1 base error, 2 nocall correction
tgtctaataa

SEQ ID NO: 3116 - DNA, 10 bp, Artificial Sequence
  synthetic Reed-Solomon code for 8+2 base, 1 base error, 2 nocall correction
tgggtaattg

SEQ ID NO: 3117 - DNA, 10 bp, Artificial Sequence
  synthetic Reed-Solomon code for 8+2 base, 1 base error, 2 nocall correction
ggtgtaattt

SEQ ID NO: 3118 - DNA, 10 bp, Artificial Sequence
  synthetic Reed-Solomon code for 8+2 base, 1 base error, 2 nocall correction
cgattaatgg

SEQ ID NO: 3119 - DNA, 10 bp, Artificial Sequence
  synthetic Reed-Solomon code for 8+2 base, 1 base error, 2 nocall correction
gtgttaatgt

SEQ ID NO: 3120 - DNA, 10 bp, Artificial Sequence
  synthetic Reed-Solomon code for 8+2 base, 1 base error, 2 nocall correction
tttttaatgg

SEQ ID NO: 3121 - DNA, 10 bp, Artificial Sequence
  synthetic Reed-Solomon code for 8+2 base, 1 base error, 2 nocall correction
acaaacattt

SEQ ID NO: 3122 - DNA, 10 bp, Artificial Sequence
  synthetic Reed-Solomon code for 8+2 base, 1 base error, 2 nocall correction
cgaaacatgc

SEQ ID NO: 3123 - DNA, 10 bp, Artificial Sequence
  synthetic Reed-Solomon code for 8+2 base, 1 base error, 2 nocall correction
agcaacatga

SEQ ID NO: 3124 - DNA, 10 bp, Artificial Sequence
  synthetic Reed-Solomon code for 8+2 base, 1 base error, 2 nocall correction
ctcaacatgt

SEQ ID NO: 3125 - DNA, 10 bp, Artificial Sequence
  synthetic Reed-Solomon code for 8+2 base, 1 base error, 2 nocall correction
aagaacatat

SEQ ID NO: 3126 - DNA, 10 bp, Artificial Sequence
  synthetic Reed-Solomon code for 8+2 base, 1 base error, 2 nocall correction
gataacatca

SEQ ID NO: 3127 - DNA, 10 bp, Artificial Sequence
  synthetic Reed-Solomon code for 8+2 base, 1 base error, 2 nocall correction
tctaacatta

SEQ ID NO: 3128 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
tttaacatgc

SEQ ID NO: 3129 - DNA, 10 bp, Artificial Sequence
  synthetic Reed-Solomon code for 8+2 base, 1 base error, 2 nocall correction
ccagacattc

SEQ ID NO: 3130 - DNA, 10 bp, Artificial Sequence
  synthetic Reed-Solomon code for 8+2 base, 1 base error, 2 nocall correction
agagacatgt

SEQ ID NO: 3131 - DNA, 10 bp, Artificial Sequence
  synthetic Reed-Solomon code for 8+2 base, 1 base error, 2 nocall correction
ctagacatga

SEQ ID NO: 3132 - DNA, 10 bp, Artificial Sequence
  synthetic Reed-Solomon code for 8+2 base, 1 base error, 2 nocall correction
gacgacatag

SEQ ID NO: 3133 - DNA, 10 bp, Artificial Sequence
  synthetic Reed-Solomon code for 8+2 base, 1 base error, 2 nocall correction
accgacatta

SEQ ID NO: 3134 - DNA, 10 bp, Artificial Sequence
  synthetic Reed-Solomon code for 8+2 base, 1 base error, 2 nocall correction
atcgacatgc

SEQ ID NO: 3135 - DNA, 10 bp, Artificial Sequence
  synthetic Reed-Solomon code for 8+2 base, 1 base error, 2 nocall correction
caggacatac

SEQ ID NO: 3136 - DNA, 10 bp, Artificial Sequence
  synthetic Reed-Solomon code for 8+2 base, 1 base error, 2 nocall correction
tgtgacatga

SEQ ID NO: 3137 - DNA, 10 bp, Artificial Sequence
  synthetic Reed-Solomon code for 8+2 base, 1 base error, 2 nocall correction
tcgtacatgc

SEQ ID NO: 3138 - DNA, 10 bp, Artificial Sequence
  synthetic Reed-Solomon code for 8+2 base, 1 base error, 2 nocall correction
ttgtacatta

SEQ ID NO: 3139 - DNA, 10 bp, Artificial Sequence
  synthetic Reed-Solomon code for 8+2 base, 1 base error, 2 nocall correction
gctaccatac

SEQ ID NO: 3140 - DNA, 10 bp, Artificial Sequence
  synthetic Reed-Solomon code for 8+2 base, 1 base error, 2 nocall correction
ccacccattt

SEQ ID NO: 3141 - DNA, 10 bp, Artificial Sequence
  synthetic Reed-Solomon code for 8+2 base, 1 base error, 2 nocall correction
agacccatgc

SEQ ID NO: 3142 - DNA, 10 bp, Artificial Sequence
  synthetic Reed-Solomon code for 8+2 base, 1 base error, 2 nocall correction
cgccccatga

SEQ ID NO: 3143 - DNA, 10 bp, Artificial Sequence
  synthetic Reed-Solomon code for 8+2 base, 1 base error, 2 nocall correction
atccccatgt

SEQ ID NO: 3144 - DNA, 10 bp, Artificial Sequence
  synthetic Reed-Solomon code for 8+2 base, 1 base error, 2 nocall correction
cagcccatat

SEQ ID NO: 3145 - DNA, 10 bp, Artificial Sequence
  synthetic Reed-Solomon code for 8+2 base, 1 base error, 2 nocall correction
ccggccatca

SEQ ID NO: 3146 - DNA, 10 bp, Artificial Sequence
  synthetic Reed-Solomon code for 8+2 base, 1 base error, 2 nocall correction
gaatccatga

SEQ ID NO: 3147 - DNA, 10 bp, Artificial Sequence
  synthetic Reed-Solomon code for 8+2 base, 1 base error, 2 nocall correction
ttatccatcc

SEQ ID NO: 3148 - DNA, 10 bp, Artificial Sequence
  synthetic Reed-Solomon code for 8+2 base, 1 base error, 2 nocall correction
tgctccatct

SEQ ID NO: 3149 - DNA, 10 bp, Artificial Sequence
  synthetic Reed-Solomon code for 8+2 base, 1 base error, 2 nocall correction
ctctccatag

SEQ ID NO: 3150 - DNA, 10 bp, Artificial Sequence
  synthetic Reed-Solomon code for 8+2 base, 1 base error, 2 nocall correction
aagtccatgg

SEQ ID NO: 3151 - DNA, 10 bp, Artificial Sequence
  synthetic Reed-Solomon code for 8+2 base, 1 base error, 2 nocall correction
gtgtccatac

SEQ ID NO: 3152 - DNA, 10 bp, Artificial Sequence
  synthetic Reed-Solomon code for 8+2 base, 1 base error, 2 nocall correction
cgttccatcc

SEQ ID NO: 3153 - DNA, 10 bp, Artificial Sequence
  synthetic Reed-Solomon code for 8+2 base, 1 base error, 2 nocall correction
ggaagcatgt

SEQ ID NO: 3154 - DNA, 10 bp, Artificial Sequence
  synthetic Reed-Solomon code for 8+2 base, 1 base error, 2 nocall correction
aacagcatag

SEQ ID NO: 3155 - DNA, 10 bp, Artificial Sequence
  synthetic Reed-Solomon code for 8+2 base, 1 base error, 2 nocall correction
tacagcatca

SEQ ID NO: 3156 - DNA, 10 bp, Artificial Sequence
  synthetic Reed-Solomon code for 8+2 base, 1 base error, 2 nocall correction
gccagcatta

SEQ ID NO: 3157 - DNA, 10 bp, Artificial Sequence
  synthetic Reed-Solomon code for 8+2 base, 1 base error, 2 nocall correction
gtcagcatgc

SEQ ID NO: 3158 - DNA, 10 bp, Artificial Sequence
  synthetic Reed-Solomon code for 8+2 base, 1 base error, 2 nocall correction
ctgagcatgg

SEQ ID NO: 3159 - DNA, 10 bp, Artificial Sequence
  synthetic Reed-Solomon code for 8+2 base, 1 base error, 2 nocall correction
acacgcatcg

SEQ ID NO: 3160 - DNA, 10 bp, Artificial Sequence
  synthetic Reed-Solomon code for 8+2 base, 1 base error, 2 nocall correction
tcacgcataa

SEQ ID NO: 3161 - DNA, 10 bp, Artificial Sequence
  synthetic Reed-Solomon code for 8+2 base, 1 base error, 2 nocall correction
tagcgcatta

SEQ ID NO: 3162 - DNA, 10 bp, Artificial Sequence
  synthetic Reed-Solomon code for 8+2 base, 1 base error, 2 nocall correction
gcgcgcatca

SEQ ID NO: 3163 - DNA, 10 bp, Artificial Sequence
  synthetic Reed-Solomon code for 8+2 base, 1 base error, 2 nocall correction
actcgcatat

SEQ ID NO: 3164 - DNA, 10 bp, Artificial Sequence
  synthetic Reed-Solomon code for 8+2 base, 1 base error, 2 nocall correction
taaggcatct

SEQ ID NO: 3165 - DNA, 10 bp, Artificial Sequence
  synthetic Reed-Solomon code for 8+2 base, 1 base error, 2 nocall correction
gcaggcattt

SEQ ID NO: 3166 - DNA, 10 bp, Artificial Sequence
  synthetic Reed-Solomon code for 8+2 base, 1 base error, 2 nocall correction
ggcggcatga

SEQ ID NO: 3167 - DNA, 10 bp, Artificial Sequence
  synthetic Reed-Solomon code for 8+2 base, 1 base error, 2 nocall correction
gagggcatat

SEQ ID NO: 3168 - DNA, 10 bp, Artificial Sequence
  synthetic Reed-Solomon code for 8+2 base, 1 base error, 2 nocall correction
aatggcatca

SEQ ID NO: 3169 - DNA, 10 bp, Artificial Sequence
  synthetic Reed-Solomon code for 8+2 base, 1 base error, 2 nocall correction
tatggcatag

SEQ ID NO: 3170 - DNA, 10 bp, Artificial Sequence
  synthetic Reed-Solomon code for 8+2 base, 1 base error, 2 nocall correction
ccttgcatgg

SEQ ID NO: 3171 - DNA, 10 bp, Artificial Sequence
  synthetic Reed-Solomon code for 8+2 base, 1 base error, 2 nocall correction
gtaatcattg

SEQ ID NO: 3172 - DNA, 10 bp, Artificial Sequence
  synthetic Reed-Solomon code for 8+2 base, 1 base error, 2 nocall correction
acgatcatgc

SEQ ID NO: 3173 - DNA, 10 bp, Artificial Sequence
  synthetic Reed-Solomon code for 8+2 base, 1 base error, 2 nocall correction
cggatcattt

SEQ ID NO: 3174 - DNA, 10 bp, Artificial Sequence
  synthetic Reed-Solomon code for 8+2 base, 1 base error, 2 nocall correction
atgatcatta

SEQ ID NO: 3175 - DNA, 10 bp, Artificial Sequence
  synthetic Reed-Solomon code for 8+2 base, 1 base error, 2 nocall correction
ctactcatcc

SEQ ID NO: 3176 - DNA, 10 bp, Artificial Sequence
  synthetic Reed-Solomon code for 8+2 base, 1 base error, 2 nocall correction
cgcctcatct

SEQ ID NO: 3177 - DNA, 10 bp, Artificial Sequence
  synthetic Reed-Solomon code for 8+2 base, 1 base error, 2 nocall correction
atcctcatca

SEQ ID NO: 3178 - DNA, 10 bp, Artificial Sequence
  synthetic Reed-Solomon code for 8+2 base, 1 base error, 2 nocall correction
ttcctcatag

SEQ ID NO: 3179 - DNA, 10 bp, Artificial Sequence
  synthetic Reed-Solomon code for 8+2 base, 1 base error, 2 nocall correction
tgtctcatcc

SEQ ID NO: 3180 - DNA, 10 bp, Artificial Sequence
  synthetic Reed-Solomon code for 8+2 base, 1 base error, 2 nocall correction
ccggtcatgt

SEQ ID NO: 3181 - DNA, 10 bp, Artificial Sequence
  synthetic Reed-Solomon code for 8+2 base, 1 base error, 2 nocall correction
agggtcattc

SEQ ID NO: 3182 - DNA, 10 bp, Artificial Sequence
  synthetic Reed-Solomon code for 8+2 base, 1 base error, 2 nocall correction
gaattcatct

SEQ ID NO: 3183 - DNA, 10 bp, Artificial Sequence
  synthetic Reed-Solomon code for 8+2 base, 1 base error, 2 nocall correction
tcattcattt

SEQ ID NO: 3184 - DNA, 10 bp, Artificial Sequence
  synthetic Reed-Solomon code for 8+2 base, 1 base error, 2 nocall correction
tgcttcatga

SEQ ID NO: 3185 - DNA, 10 bp, Artificial Sequence
  synthetic Reed-Solomon code for 8+2 base, 1 base error, 2 nocall correction
tagttcatat

SEQ ID NO: 3186 - DNA, 10 bp, Artificial Sequence
  synthetic Reed-Solomon code for 8+2 base, 1 base error, 2 nocall correction
gatttcatag

SEQ ID NO: 3187 - DNA, 10 bp, Artificial Sequence
  synthetic Reed-Solomon code for 8+2 base, 1 base error, 2 nocall correction
actttcatta

SEQ ID NO: 3188 - DNA, 10 bp, Artificial Sequence
  synthetic Reed-Solomon code for 8+2 base, 1 base error, 2 nocall correction
attttcatgc

SEQ ID NO: 3189 - DNA, 10 bp, Artificial Sequence
  synthetic Reed-Solomon code for 8+2 base, 1 base error, 2 nocall correction
cgaaagatcg

SEQ ID NO: 3190 - DNA, 10 bp, Artificial Sequence
  synthetic Reed-Solomon code for 8+2 base, 1 base error, 2 nocall correction
ttaaagatat

SEQ ID NO: 3191 - DNA, 10 bp, Artificial Sequence
  synthetic Reed-Solomon code for 8+2 base, 1 base error, 2 nocall correction
tgcaagatac

SEQ ID NO: 3192 - DNA, 10 bp, Artificial Sequence
  synthetic Reed-Solomon code for 8+2 base, 1 base error, 2 nocall correction
gtgaagatct

SEQ ID NO: 3193 - DNA, 10 bp, Artificial Sequence
  synthetic Reed-Solomon code for 8+2 base, 1 base error, 2 nocall correction
cgtaagatat

SEQ ID NO: 3194 - DNA, 10 bp, Artificial Sequence
  synthetic Reed-Solomon code for 8+2 base, 1 base error, 2 nocall correction
attaagataa

SEQ ID NO: 3195 - DNA, 10 bp, Artificial Sequence
  synthetic Reed-Solomon code for 8+2 base, 1 base error, 2 nocall correction
tttaagatcg

SEQ ID NO: 3196 - DNA, 10 bp, Artificial Sequence
  synthetic Reed-Solomon code for 8+2 base, 1 base error, 2 nocall correction
ggacagattc

SEQ ID NO: 3197 - DNA, 10 bp, Artificial Sequence
  synthetic Reed-Solomon code for 8+2 base, 1 base error, 2 nocall correction
gtccagattt

SEQ ID NO: 3198 - DNA, 10 bp, Artificial Sequence
  synthetic Reed-Solomon code for 8+2 base, 1 base error, 2 nocall correction
atcgagatcg

SEQ ID NO: 3199 - DNA, 10 bp, Artificial Sequence
  synthetic Reed-Solomon code for 8+2 base, 1 base error, 2 nocall correction
ttcgagataa

SEQ ID NO: 3200 - DNA, 10 bp, Artificial Sequence
  synthetic Reed-Solomon code for 8+2 base, 1 base error, 2 nocall correction
agtgagatac

SEQ ID NO: 3201 - DNA, 10 bp, Artificial Sequence
  synthetic Reed-Solomon code for 8+2 base, 1 base error, 2 nocall correction
aaatagatta

SEQ ID NO: 3202 - DNA, 10 bp, Artificial Sequence
  synthetic Reed-Solomon code for 8+2 base, 1 base error, 2 nocall correction
gcatagatag

SEQ ID NO: 3203 - DNA, 10 bp, Artificial Sequence
  synthetic Reed-Solomon code for 8+2 base, 1 base error, 2 nocall correction
cactagattc

SEQ ID NO: 3204 - DNA, 10 bp, Artificial Sequence
  synthetic Reed-Solomon code for 8+2 base, 1 base error, 2 nocall correction
gagtagattg

SEQ ID NO: 3205 - DNA, 10 bp, Artificial Sequence
  synthetic Reed-Solomon code for 8+2 base, 1 base error, 2 nocall correction
acgtagataa

SEQ ID NO: 3206 - DNA, 10 bp, Artificial Sequence
  synthetic Reed-Solomon code for 8+2 base, 1 base error, 2 nocall correction
tcgtagatcg

SEQ ID NO: 3207 - DNA, 10 bp, Artificial Sequence
  synthetic Reed-Solomon code for 8+2 base, 1 base error, 2 nocall correction
tattagattt

SEQ ID NO: 3208 - DNA, 10 bp, Artificial Sequence
  synthetic Reed-Solomon code for 8+2 base, 1 base error, 2 nocall correction
gcttagatct

SEQ ID NO: 3209 - DNA, 10 bp, Artificial Sequence
  synthetic Reed-Solomon code for 8+2 base, 1 base error, 2 nocall correction
gcaacgatgt

SEQ ID NO: 3210 - DNA, 10 bp, Artificial Sequence
  synthetic Reed-Solomon code for 8+2 base, 1 base error, 2 nocall correction
ggcacgatta

SEQ ID NO: 3211 - DNA, 10 bp, Artificial Sequence
  synthetic Reed-Solomon code for 8+2 base, 1 base error, 2 nocall correction
agaccgatcg

SEQ ID NO: 3212 - DNA, 10 bp, Artificial Sequence
  synthetic Reed-Solomon code for 8+2 base, 1 base error, 2 nocall correction
tgaccgataa

SEQ ID NO: 3213 - DNA, 10 bp, Artificial Sequence
  synthetic Reed-Solomon code for 8+2 base, 1 base error, 2 nocall correction
gggccgatca

SEQ ID NO: 3214 - DNA, 10 bp, Artificial Sequence
  synthetic Reed-Solomon code for 8+2 base, 1 base error, 2 nocall correction
agtccgatat

SEQ ID NO: 3215 - DNA, 10 bp, Artificial Sequence
  synthetic Reed-Solomon code for 8+2 base, 1 base error, 2 nocall correction
cttccgataa

SEQ ID NO: 3216 - DNA, 10 bp, Artificial Sequence
  synthetic Reed-Solomon code for 8+2 base, 1 base error, 2 nocall correction
ggagcgattt

SEQ ID NO: 3217 - DNA, 10 bp, Artificial Sequence
  synthetic Reed-Solomon code for 8+2 base, 1 base error, 2 nocall correction
gccgcgatga

SEQ ID NO: 3218 - DNA, 10 bp, Artificial Sequence
  synthetic Reed-Solomon code for 8+2 base, 1 base error, 2 nocall correction
gtcgcgattc

SEQ ID NO: 3219 - DNA, 10 bp, Artificial Sequence
  synthetic Reed-Solomon code for 8+2 base, 1 base error, 2 nocall correction
ctggcgattg

SEQ ID NO: 3220 - DNA, 10 bp, Artificial Sequence
  synthetic Reed-Solomon code for 8+2 base, 1 base error, 2 nocall correction
ttatcgatgg

SEQ ID NO: 3221 - DNA, 10 bp, Artificial Sequence
  synthetic Reed-Solomon code for 8+2 base, 1 base error, 2 nocall correction
aagtcgatcc

SEQ ID NO: 3222 - DNA, 10 bp, Artificial Sequence
  synthetic Reed-Solomon code for 8+2 base, 1 base error, 2 nocall correction
cgttcgatgg

SEQ ID NO: 3223 - DNA, 10 bp, Artificial Sequence
  synthetic Reed-Solomon code for 8+2 base, 1 base error, 2 nocall correction
gtcaggatcg

SEQ ID NO: 3224 - DNA, 10 bp, Artificial Sequence
  synthetic Reed-Solomon code for 8+2 base, 1 base error, 2 nocall correction
ctgaggatcc

SEQ ID NO: 3225 - DNA, 10 bp, Artificial Sequence
  synthetic Reed-Solomon code for 8+2 base, 1 base error, 2 nocall correction
ggtaggatac

SEQ ID NO: 3226 - DNA, 10 bp, Artificial Sequence
  synthetic Reed-Solomon code for 8+2 base, 1 base error, 2 nocall correction
acacggatgc

SEQ ID NO: 3227 - DNA, 10 bp, Artificial Sequence
  synthetic Reed-Solomon code for 8+2 base, 1 base error, 2 nocall correction
cgacggattt

SEQ ID NO: 3228 - DNA, 10 bp, Artificial Sequence
  synthetic Reed-Solomon code for 8+2 base, 1 base error, 2 nocall correction
atacggatta

SEQ ID NO: 3229 - DNA, 10 bp, Artificial Sequence
  synthetic Reed-Solomon code for 8+2 base, 1 base error, 2 nocall correction
ccccggatga

SEQ ID NO: 3230 - DNA, 10 bp, Artificial Sequence
  synthetic Reed-Solomon code for 8+2 base, 1 base error, 2 nocall correction
ctccggattc

SEQ ID NO: 3231 - DNA, 10 bp, Artificial Sequence
  synthetic Reed-Solomon code for 8+2 base, 1 base error, 2 nocall correction
gtgcggattg

SEQ ID NO: 3232 - DNA, 10 bp, Artificial Sequence
  synthetic Reed-Solomon code for 8+2 base, 1 base error, 2 nocall correction
tttcggattt

SEQ ID NO: 3233 - DNA, 10 bp, Artificial Sequence
  synthetic Reed-Solomon code for 8+2 base, 1 base error, 2 nocall correction
cgggggatca

SEQ ID NO: 3234 - DNA, 10 bp, Artificial Sequence
  synthetic Reed-Solomon code for 8+2 base, 1 base error, 2 nocall correction
atggggatct

SEQ ID NO: 3235 - DNA, 10 bp, Artificial Sequence
  synthetic Reed-Solomon code for 8+2 base, 1 base error, 2 nocall correction
gttgggataa

SEQ ID NO: 3236 - DNA, 10 bp, Artificial Sequence
  synthetic Reed-Solomon code for 8+2 base, 1 base error, 2 nocall correction
gactggattt

SEQ ID NO: 3237 - DNA, 10 bp, Artificial Sequence
  synthetic Reed-Solomon code for 8+2 base, 1 base error, 2 nocall correction
tcctggatct

SEQ ID NO: 3238 - DNA, 10 bp, Artificial Sequence
  synthetic Reed-Solomon code for 8+2 base, 1 base error, 2 nocall correction
ccttggatcc

SEQ ID NO: 3239 - DNA, 10 bp, Artificial Sequence
  synthetic Reed-Solomon code for 8+2 base, 1 base error, 2 nocall correction
taaatgatta

SEQ ID NO: 3240 - DNA, 10 bp, Artificial Sequence
  synthetic Reed-Solomon code for 8+2 base, 1 base error, 2 nocall correction
gcaatgatca

SEQ ID NO: 3241 - DNA, 10 bp, Artificial Sequence
  synthetic Reed-Solomon code for 8+2 base, 1 base error, 2 nocall correction
acgatgatcg

SEQ ID NO: 3242 - DNA, 10 bp, Artificial Sequence
  synthetic Reed-Solomon code for 8+2 base, 1 base error, 2 nocall correction
tcgatgataa

SEQ ID NO: 3243 - DNA, 10 bp, Artificial Sequence
  synthetic Reed-Solomon code for 8+2 base, 1 base error, 2 nocall correction
aatatgattt

SEQ ID NO: 3244 - DNA, 10 bp, Artificial Sequence
  synthetic Reed-Solomon code for 8+2 base, 1 base error, 2 nocall correction
ctactgatgg

SEQ ID NO: 3245 - DNA, 10 bp, Artificial Sequence
  synthetic Reed-Solomon code for 8+2 base, 1 base error, 2 nocall correction
gacctgataa

SEQ ID NO: 3246 - DNA, 10 bp, Artificial Sequence
  synthetic Reed-Solomon code for 8+2 base, 1 base error, 2 nocall correction
accctgattg

SEQ ID NO: 3247 - DNA, 10 bp, Artificial Sequence
  synthetic Reed-Solomon code for 8+2 base, 1 base error, 2 nocall correction
gggctgatgt

SEQ ID NO: 3248 - DNA, 10 bp, Artificial Sequence
  synthetic Reed-Solomon code for 8+2 base, 1 base error, 2 nocall correction
tgtctgatgg

SEQ ID NO: 3249 - DNA, 10 bp, Artificial Sequence
  synthetic Reed-Solomon code for 8+2 base, 1 base error, 2 nocall correction
tacgtgattt

SEQ ID NO: 3250 - DNA, 10 bp, Artificial Sequence
  synthetic Reed-Solomon code for 8+2 base, 1 base error, 2 nocall correction
gccgtgatct

SEQ ID NO: 3251 - DNA, 10 bp, Artificial Sequence
  synthetic Reed-Solomon code for 8+2 base, 1 base error, 2 nocall correction
catgtgattc

SEQ ID NO: 3252 - DNA, 10 bp, Artificial Sequence
  synthetic Reed-Solomon code for 8+2 base, 1 base error, 2 nocall correction
cgattgataa

SEQ ID NO: 3253 - DNA, 10 bp, Artificial Sequence
  synthetic Reed-Solomon code for 8+2 base, 1 base error, 2 nocall correction
atattgatat

SEQ ID NO: 3254 - DNA, 10 bp, Artificial Sequence
  synthetic Reed-Solomon code for 8+2 base, 1 base error, 2 nocall correction
agcttgatac

SEQ ID NO: 3255 - DNA, 10 bp, Artificial Sequence
  synthetic Reed-Solomon code for 8+2 base, 1 base error, 2 nocall correction
attttgatcg

SEQ ID NO: 3256 - DNA, 10 bp, Artificial Sequence
  synthetic Reed-Solomon code for 8+2 base, 1 base error, 2 nocall correction
tttttgataa

SEQ ID NO: 3257 - DNA, 10 bp, Artificial Sequence
  synthetic Reed-Solomon code for 8+2 base, 1 base error, 2 nocall correction
acaaatatcc

SEQ ID NO: 3258 - DNA, 10 bp, Artificial Sequence
  synthetic Reed-Solomon code for 8+2 base, 1 base error, 2 nocall correction
cccaatatca

SEQ ID NO: 3259 - DNA, 10 bp, Artificial Sequence
  synthetic Reed-Solomon code for 8+2 base, 1 base error, 2 nocall correction
caacatataa

SEQ ID NO: 3260 - DNA, 10 bp, Artificial Sequence
  synthetic Reed-Solomon code for 8+2 base, 1 base error, 2 nocall correction
aaccatatac

SEQ ID NO: 3261 - DNA, 10 bp, Artificial Sequence
  synthetic Reed-Solomon code for 8+2 base, 1 base error, 2 nocall correction
gtccatatgg

SEQ ID NO: 3262 - DNA, 10 bp, Artificial Sequence
  synthetic Reed-Solomon code for 8+2 base, 1 base error, 2 nocall correction
ccgcatatta

SEQ ID NO: 3263 - DNA, 10 bp, Artificial Sequence
  synthetic Reed-Solomon code for 8+2 base, 1 base error, 2 nocall correction
ctgcatatgc

SEQ ID NO: 3264 - DNA, 10 bp, Artificial Sequence
  synthetic Reed-Solomon code for 8+2 base, 1 base error, 2 nocall correction
ccagatatct

SEQ ID NO: 3265 - DNA, 10 bp, Artificial Sequence
  synthetic Reed-Solomon code for 8+2 base, 1 base error, 2 nocall correction
cctgatatag

SEQ ID NO: 3266 - DNA, 10 bp, Artificial Sequence
  synthetic Reed-Solomon code for 8+2 base, 1 base error, 2 nocall correction
ggctatataa

SEQ ID NO: 3267 - DNA, 10 bp, Artificial Sequence
  synthetic Reed-Solomon code for 8+2 base, 1 base error, 2 nocall correction
gagtatatgt

SEQ ID NO: 3268 - DNA, 10 bp, Artificial Sequence
  synthetic Reed-Solomon code for 8+2 base, 1 base error, 2 nocall correction
tattatatgg

SEQ ID NO: 3269 - DNA, 10 bp, Artificial Sequence
  synthetic Reed-Solomon code for 8+2 base, 1 base error, 2 nocall correction
aaaactataa

SEQ ID NO: 3270 - DNA, 10 bp, Artificial Sequence
  synthetic Reed-Solomon code for 8+2 base, 1 base error, 2 nocall correction
taaactatcg

SEQ ID NO: 3271 - DNA, 10 bp, Artificial Sequence
  synthetic Reed-Solomon code for 8+2 base, 1 base error, 2 nocall correction
gcaactattg

SEQ ID NO: 3272 - DNA, 10 bp, Artificial Sequence
  synthetic Reed-Solomon code for 8+2 base, 1 base error, 2 nocall correction
cacactatac

SEQ ID NO: 3273 - DNA, 10 bp, Artificial Sequence
  synthetic Reed-Solomon code for 8+2 base, 1 base error, 2 nocall correction
gagactatag

SEQ ID NO: 3274 - DNA, 10 bp, Artificial Sequence
  synthetic Reed-Solomon code for 8+2 base, 1 base error, 2 nocall correction
acgactatta

SEQ ID NO: 3275 - DNA, 10 bp, Artificial Sequence
  synthetic Reed-Solomon code for 8+2 base, 1 base error, 2 nocall correction
atgactatgc

SEQ ID NO: 3276 - DNA, 10 bp, Artificial Sequence
  synthetic Reed-Solomon code for 8+2 base, 1 base error, 2 nocall correction
tatactatat

SEQ ID NO: 3277 - DNA, 10 bp, Artificial Sequence
  synthetic Reed-Solomon code for 8+2 base, 1 base error, 2 nocall correction
ccacctatcc

SEQ ID NO: 3278 - DNA, 10 bp, Artificial Sequence
  synthetic Reed-Solomon code for 8+2 base, 1 base error, 2 nocall correction
acccctatca

SEQ ID NO: 3279 - DNA, 10 bp, Artificial Sequence
  synthetic Reed-Solomon code for 8+2 base, 1 base error, 2 nocall correction
tcccctatag

SEQ ID NO: 3280 - DNA, 10 bp, Artificial Sequence
  synthetic Reed-Solomon code for 8+2 base, 1 base error, 2 nocall correction
ggagctatgg

SEQ ID NO: 3281 - DNA, 10 bp, Artificial Sequence
  synthetic Reed-Solomon code for 8+2 base, 1 base error, 2 nocall correction
aacgctatat

SEQ ID NO: 3282 - DNA, 10 bp, Artificial Sequence
  synthetic Reed-Solomon code for 8+2 base, 1 base error, 2 nocall correction
agggctatga

SEQ ID NO: 3283 - DNA, 10 bp, Artificial Sequence
  synthetic Reed-Solomon code for 8+2 base, 1 base error, 2 nocall correction
ctggctatgt

SEQ ID NO: 3284 - DNA, 10 bp, Artificial Sequence
  synthetic Reed-Solomon code for 8+2 base, 1 base error, 2 nocall correction
ttatctattt

SEQ ID NO: 3285 - DNA, 10 bp, Artificial Sequence
  synthetic Reed-Solomon code for 8+2 base, 1 base error, 2 nocall correction
tgctctattc

SEQ ID NO: 3286 - DNA, 10 bp, Artificial Sequence
  synthetic Reed-Solomon code for 8+2 base, 1 base error, 2 nocall correction
acttctatgc

SEQ ID NO: 3287 - DNA, 10 bp, Artificial Sequence
  synthetic Reed-Solomon code for 8+2 base, 1 base error, 2 nocall correction
cgttctattt

SEQ ID NO: 3288 - DNA, 10 bp, Artificial Sequence
  synthetic Reed-Solomon code for 8+2 base, 1 base error, 2 nocall correction
atttctatta

SEQ ID NO: 3289 - DNA, 10 bp, Artificial Sequence
  synthetic Reed-Solomon code for 8+2 base, 1 base error, 2 nocall correction
catagtatta

SEQ ID NO: 3290 - DNA, 10 bp, Artificial Sequence
  synthetic Reed-Solomon code for 8+2 base, 1 base error, 2 nocall correction
cgacgtatgg

SEQ ID NO: 3291 - DNA, 10 bp, Artificial Sequence
  synthetic Reed-Solomon code for 8+2 base, 1 base error, 2 nocall correction
gtgcgtatgt

SEQ ID NO: 3292 - DNA, 10 bp, Artificial Sequence
  synthetic Reed-Solomon code for 8+2 base, 1 base error, 2 nocall correction
tttcgtatgg

SEQ ID NO: 3293 - DNA, 10 bp, Artificial Sequence
  synthetic Reed-Solomon code for 8+2 base, 1 base error, 2 nocall correction
taaggtattc

SEQ ID NO: 3294 - DNA, 10 bp, Artificial Sequence
  synthetic Reed-Solomon code for 8+2 base, 1 base error, 2 nocall correction
gcaggtatcc

SEQ ID NO: 3295 - DNA, 10 bp, Artificial Sequence
  synthetic Reed-Solomon code for 8+2 base, 1 base error, 2 nocall correction
tcgggtatac

SEQ ID NO: 3296 - DNA, 10 bp, Artificial Sequence
  synthetic Reed-Solomon code for 8+2 base, 1 base error, 2 nocall correction
agatgtatat

SEQ ID NO: 3297 - DNA, 10 bp, Artificial Sequence
  synthetic Reed-Solomon code for 8+2 base, 1 base error, 2 nocall correction
ctatgtataa

SEQ ID NO: 3298 - DNA, 10 bp, Artificial Sequence
  synthetic Reed-Solomon code for 8+2 base, 1 base error, 2 nocall correction
gactgtatgg

SEQ ID NO: 3299 - DNA, 10 bp, Artificial Sequence
  synthetic Reed-Solomon code for 8+2 base, 1 base error, 2 nocall correction
atctgtatac

SEQ ID NO: 3300 - DNA, 10 bp, Artificial Sequence
  synthetic Reed-Solomon code for 8+2 base, 1 base error, 2 nocall correction
cagtgtatgc

SEQ ID NO: 3301 - DNA, 10 bp, Artificial Sequence
  synthetic Reed-Solomon code for 8+2 base, 1 base error, 2 nocall correction
agttgtatcg

SEQ ID NO: 3302 - DNA, 10 bp, Artificial Sequence
  synthetic Reed-Solomon code for 8+2 base, 1 base error, 2 nocall correction
tgttgtataa

SEQ ID NO: 3303 - DNA, 10 bp, Artificial Sequence
  synthetic Reed-Solomon code for 8+2 base, 1 base error, 2 nocall correction
ggcattatcg

SEQ ID NO: 3304 - DNA, 10 bp, Artificial Sequence
  synthetic Reed-Solomon code for 8+2 base, 1 base error, 2 nocall correction
cggattatcc

SEQ ID NO: 3305 - DNA, 10 bp, Artificial Sequence
  synthetic Reed-Solomon code for 8+2 base, 1 base error, 2 nocall correction
aatattatgg

SEQ ID NO: 3306 - DNA, 10 bp, Artificial Sequence
  synthetic Reed-Solomon code for 8+2 base, 1 base error, 2 nocall correction
gttattatac

SEQ ID NO: 3307 - DNA, 10 bp, Artificial Sequence
  synthetic Reed-Solomon code for 8+2 base, 1 base error, 2 nocall correction
agacttatta

SEQ ID NO: 3308 - DNA, 10 bp, Artificial Sequence
  synthetic Reed-Solomon code for 8+2 base, 1 base error, 2 nocall correction
ctacttattt

SEQ ID NO: 3309 - DNA, 10 bp, Artificial Sequence
  synthetic Reed-Solomon code for 8+2 base, 1 base error, 2 nocall correction
acccttatgt

SEQ ID NO: 3310 - DNA, 10 bp, Artificial Sequence
  synthetic Reed-Solomon code for 8+2 base, 1 base error, 2 nocall correction
cgccttattc

SEQ ID NO: 3311 - DNA, 10 bp, Artificial Sequence
  synthetic Reed-Solomon code for 8+2 base, 1 base error, 2 nocall correction
gggcttattg

SEQ ID NO: 3312 - DNA, 10 bp, Artificial Sequence
  synthetic Reed-Solomon code for 8+2 base, 1 base error, 2 nocall correction
tgtcttattt

SEQ ID NO: 3313 - DNA, 10 bp, Artificial Sequence
  synthetic Reed-Solomon code for 8+2 base, 1 base error, 2 nocall correction
tacgttatgg

SEQ ID NO: 3314 - DNA, 10 bp, Artificial Sequence
  synthetic Reed-Solomon code for 8+2 base, 1 base error, 2 nocall correction
agggttatct

SEQ ID NO: 3315 - DNA, 10 bp, Artificial Sequence
  synthetic Reed-Solomon code for 8+2 base, 1 base error, 2 nocall correction
ctggttatca

SEQ ID NO: 3316 - DNA, 10 bp, Artificial Sequence
  synthetic Reed-Solomon code for 8+2 base, 1 base error, 2 nocall correction
ggtgttataa

SEQ ID NO: 3317 - DNA, 10 bp, Artificial Sequence
  synthetic Reed-Solomon code for 8+2 base, 1 base error, 2 nocall correction
gaatttattc

SEQ ID NO: 3318 - DNA, 10 bp, Artificial Sequence
  synthetic Reed-Solomon code for 8+2 base, 1 base error, 2 nocall correction
tcatttatcc

SEQ ID NO: 3319 - DNA, 10 bp, Artificial Sequence
  synthetic Reed-Solomon code for 8+2 base, 1 base error, 2 nocall correction
ccctttatag

SEQ ID NO: 3320 - DNA, 10 bp, Artificial Sequence
  synthetic Reed-Solomon code for 8+2 base, 1 base error, 2 nocall correction
gcgtttatac

SEQ ID NO: 3321 - DNA, 10 bp, Artificial Sequence
  synthetic Reed-Solomon code for 8+2 base, 1 base error, 2 nocall correction
agaaaactga

SEQ ID NO: 3322 - DNA, 10 bp, Artificial Sequence
  synthetic Reed-Solomon code for 8+2 base, 1 base error, 2 nocall correction
ctaaaactgt

SEQ ID NO: 3323 - DNA, 10 bp, Artificial Sequence
  synthetic Reed-Solomon code for 8+2 base, 1 base error, 2 nocall correction
accaaacttt

SEQ ID NO: 3324 - DNA, 10 bp, Artificial Sequence
  synthetic Reed-Solomon code for 8+2 base, 1 base error, 2 nocall correction
cgcaaactgc

SEQ ID NO: 3325 - DNA, 10 bp, Artificial Sequence
  synthetic Reed-Solomon code for 8+2 base, 1 base error, 2 nocall correction
gggaaactgg

SEQ ID NO: 3326 - DNA, 10 bp, Artificial Sequence
  synthetic Reed-Solomon code for 8+2 base, 1 base error, 2 nocall correction
tgtaaactgt

SEQ ID NO: 3327 - DNA, 10 bp, Artificial Sequence
  synthetic Reed-Solomon code for 8+2 base, 1 base error, 2 nocall correction
acgcaactct

SEQ ID NO: 3328 - DNA, 10 bp, Artificial Sequence
  synthetic Reed-Solomon code for 8+2 base, 1 base error, 2 nocall correction
aatcaacttg

SEQ ID NO: 3329 - DNA, 10 bp, Artificial Sequence
  synthetic Reed-Solomon code for 8+2 base, 1 base error, 2 nocall correction
gctcaactaa

SEQ ID NO: 3330 - DNA, 10 bp, Artificial Sequence
  synthetic Reed-Solomon code for 8+2 base, 1 base error, 2 nocall correction
gaagaactag

SEQ ID NO: 3331 - DNA, 10 bp, Artificial Sequence
  synthetic Reed-Solomon code for 8+2 base, 1 base error, 2 nocall correction
acagaactta

SEQ ID NO: 3332 - DNA, 10 bp, Artificial Sequence
  synthetic Reed-Solomon code for 8+2 base, 1 base error, 2 nocall correction
atagaactgc

SEQ ID NO: 3333 - DNA, 10 bp, Artificial Sequence
  synthetic Reed-Solomon code for 8+2 base, 1 base error, 2 nocall correction
cccgaacttc

SEQ ID NO: 3334 - DNA, 10 bp, Artificial Sequence
  synthetic Reed-Solomon code for 8+2 base, 1 base error, 2 nocall correction
agcgaactgt

SEQ ID NO: 3335 - DNA, 10 bp, Artificial Sequence
  synthetic Reed-Solomon code for 8+2 base, 1 base error, 2 nocall correction
ctcgaactga

SEQ ID NO: 3336 - DNA, 10 bp, Artificial Sequence
  synthetic Reed-Solomon code for 8+2 base, 1 base error, 2 nocall correction
aaggaactaa

SEQ ID NO: 3337 - DNA, 10 bp, Artificial Sequence
  synthetic Reed-Solomon code for 8+2 base, 1 base error, 2 nocall correction
taggaactcg

SEQ ID NO: 3338 - DNA, 10 bp, Artificial Sequence
  synthetic Reed-Solomon code for 8+2 base, 1 base error, 2 nocall correction
gcggaacttg

SEQ ID NO: 3339 - DNA, 10 bp, Artificial Sequence
  synthetic Reed-Solomon code for 8+2 base, 1 base error, 2 nocall correction
gatgaactct

SEQ ID NO: 3340 - DNA, 10 bp, Artificial Sequence
  synthetic Reed-Solomon code for 8+2 base, 1 base error, 2 nocall correction
tctgaacttt

SEQ ID NO: 3341 - DNA, 10 bp, Artificial Sequence
  synthetic Reed-Solomon code for 8+2 base, 1 base error, 2 nocall correction
ccgacactct

SEQ ID NO: 3342 - DNA, 10 bp, Artificial Sequence
  synthetic Reed-Solomon code for 8+2 base, 1 base error, 2 nocall correction
catacacttg

SEQ ID NO: 3343 - DNA, 10 bp, Artificial Sequence
  synthetic Reed-Solomon code for 8+2 base, 1 base error, 2 nocall correction
cgaccactga

SEQ ID NO: 3344 - DNA, 10 bp, Artificial Sequence
  synthetic Reed-Solomon code for 8+2 base, 1 base error, 2 nocall correction
ataccactgt

SEQ ID NO: 3345 - DNA, 10 bp, Artificial Sequence
  synthetic Reed-Solomon code for 8+2 base, 1 base error, 2 nocall correction
cccccacttt

SEQ ID NO: 3346 - DNA, 10 bp, Artificial Sequence
  synthetic Reed-Solomon code for 8+2 base, 1 base error, 2 nocall correction
agcccactgc

SEQ ID NO: 3347 - DNA, 10 bp, Artificial Sequence
  synthetic Reed-Solomon code for 8+2 base, 1 base error, 2 nocall correction
gatccactcc

SEQ ID NO: 3348 - DNA, 10 bp, Artificial Sequence
  synthetic Reed-Solomon code for 8+2 base, 1 base error, 2 nocall correction
tctccacttc

SEQ ID NO: 3349 - DNA, 10 bp, Artificial Sequence
  synthetic Reed-Solomon code for 8+2 base, 1 base error, 2 nocall correction
tttccactga

SEQ ID NO: 3350 - DNA, 10 bp, Artificial Sequence
  synthetic Reed-Solomon code for 8+2 base, 1 base error, 2 nocall correction
acggcactcc

SEQ ID NO: 3351 - DNA, 10 bp, Artificial Sequence
  synthetic Reed-Solomon code for 8+2 base, 1 base error, 2 nocall correction
tgatcactct

SEQ ID NO: 3352 - DNA, 10 bp, Artificial Sequence
  synthetic Reed-Solomon code for 8+2 base, 1 base error, 2 nocall correction
ctatcactag

SEQ ID NO: 3353 - DNA, 10 bp, Artificial Sequence
  synthetic Reed-Solomon code for 8+2 base, 1 base error, 2 nocall correction
gactcactga

SEQ ID NO: 3354 - DNA, 10 bp, Artificial Sequence
  synthetic Reed-Solomon code for 8+2 base, 1 base error, 2 nocall correction
ttctcactcc

SEQ ID NO: 3355 - DNA, 10 bp, Artificial Sequence
  synthetic Reed-Solomon code for 8+2 base, 1 base error, 2 nocall correction
gggtcactat

SEQ ID NO: 3356 - DNA, 10 bp, Artificial Sequence
  synthetic Reed-Solomon code for 8+2 base, 1 base error, 2 nocall correction
agttcactca

SEQ ID NO: 3357 - DNA, 10 bp, Artificial Sequence
  synthetic Reed-Solomon code for 8+2 base, 1 base error, 2 nocall correction
tgttcactag

SEQ ID NO: 3358 - DNA, 10 bp, Artificial Sequence
  synthetic Reed-Solomon code for 8+2 base, 1 base error, 2 nocall correction
ctttcactct

SEQ ID NO: 3359 - DNA, 10 bp, Artificial Sequence
  synthetic Reed-Solomon code for 8+2 base, 1 base error, 2 nocall correction
aaaagactag

SEQ ID NO: 3360 - DNA, 10 bp, Artificial Sequence
  synthetic Reed-Solomon code for 8+2 base, 1 base error, 2 nocall correction
taaagactca

SEQ ID NO: 3361 - DNA, 10 bp, Artificial Sequence
  synthetic Reed-Solomon code for 8+2 base, 1 base error, 2 nocall correction
gcaagactta

SEQ ID NO: 3362 - DNA, 10 bp, Artificial Sequence
  synthetic Reed-Solomon code for 8+2 base, 1 base error, 2 nocall correction
gtaagactgc

SEQ ID NO: 3363 - DNA, 10 bp, Artificial Sequence
  synthetic Reed-Solomon code for 8+2 base, 1 base error, 2 nocall correction
ggcagactgt

SEQ ID NO: 3364 - DNA, 10 bp, Artificial Sequence
  synthetic Reed-Solomon code for 8+2 base, 1 base error, 2 nocall correction
gagagactaa

SEQ ID NO: 3365 - DNA, 10 bp, Artificial Sequence
  synthetic Reed-Solomon code for 8+2 base, 1 base error, 2 nocall correction
acgagacttg

SEQ ID NO: 3366 - DNA, 10 bp, Artificial Sequence
  synthetic Reed-Solomon code for 8+2 base, 1 base error, 2 nocall correction
aatagactct

SEQ ID NO: 3367 - DNA, 10 bp, Artificial Sequence
  synthetic Reed-Solomon code for 8+2 base, 1 base error, 2 nocall correction
acccgactcg

SEQ ID NO: 3368 - DNA, 10 bp, Artificial Sequence
  synthetic Reed-Solomon code for 8+2 base, 1 base error, 2 nocall correction
tcccgactaa

SEQ ID NO: 3369 - DNA, 10 bp, Artificial Sequence
  synthetic Reed-Solomon code for 8+2 base, 1 base error, 2 nocall correction
ggaggactga

SEQ ID NO: 3370 - DNA, 10 bp, Artificial Sequence
  synthetic Reed-Solomon code for 8+2 base, 1 base error, 2 nocall correction
tacggactct

SEQ ID NO: 3371 - DNA, 10 bp, Artificial Sequence
  synthetic Reed-Solomon code for 8+2 base, 1 base error, 2 nocall correction
gccggacttt

SEQ ID NO: 3372 - DNA, 10 bp, Artificial Sequence
  synthetic Reed-Solomon code for 8+2 base, 1 base error, 2 nocall correction
aggggactgg

SEQ ID NO: 3373 - DNA, 10 bp, Artificial Sequence
  synthetic Reed-Solomon code for 8+2 base, 1 base error, 2 nocall correction
catggactcc

SEQ ID NO: 3374 - DNA, 10 bp, Artificial Sequence
  synthetic Reed-Solomon code for 8+2 base, 1 base error, 2 nocall correction
atttgacttg

SEQ ID NO: 3375 - DNA, 10 bp, Artificial Sequence
  synthetic Reed-Solomon code for 8+2 base, 1 base error, 2 nocall correction
gtcatacttg

SEQ ID NO: 3376 - DNA, 10 bp, Artificial Sequence
  synthetic Reed-Solomon code for 8+2 base, 1 base error, 2 nocall correction
ccgatactga

SEQ ID NO: 3377 - DNA, 10 bp, Artificial Sequence
  synthetic Reed-Solomon code for 8+2 base, 1 base error, 2 nocall correction
ctgatacttc

SEQ ID NO: 3378 - DNA, 10 bp, Artificial Sequence
  synthetic Reed-Solomon code for 8+2 base, 1 base error, 2 nocall correction
cgactactct

SEQ ID NO: 3379 - DNA, 10 bp, Artificial Sequence
  synthetic Reed-Solomon code for 8+2 base, 1 base error, 2 nocall correction
atactactca

SEQ ID NO: 3380 - DNA, 10 bp, Artificial Sequence
  synthetic Reed-Solomon code for 8+2 base, 1 base error, 2 nocall correction
ttactactag

SEQ ID NO: 3381 - DNA, 10 bp, Artificial Sequence
  synthetic Reed-Solomon code for 8+2 base, 1 base error, 2 nocall correction
ctcctactcc

SEQ ID NO: 3382 - DNA, 10 bp, Artificial Sequence
  synthetic Reed-Solomon code for 8+2 base, 1 base error, 2 nocall correction
gtgctactcg

SEQ ID NO: 3383 - DNA, 10 bp, Artificial Sequence
  synthetic Reed-Solomon code for 8+2 base, 1 base error, 2 nocall correction
cgtctactag

SEQ ID NO: 3384 - DNA, 10 bp, Artificial Sequence
  synthetic Reed-Solomon code for 8+2 base, 1 base error, 2 nocall correction
tttctactct

SEQ ID NO: 3385 - DNA, 10 bp, Artificial Sequence
  synthetic Reed-Solomon code for 8+2 base, 1 base error, 2 nocall correction
cgggtactta

SEQ ID NO: 3386 - DNA, 10 bp, Artificial Sequence
  synthetic Reed-Solomon code for 8+2 base, 1 base error, 2 nocall correction
atggtacttt

SEQ ID NO: 3387 - DNA, 10 bp, Artificial Sequence
  synthetic Reed-Solomon code for 8+2 base, 1 base error, 2 nocall correction
tgattactga

SEQ ID NO: 3388 - DNA, 10 bp, Artificial Sequence
  synthetic Reed-Solomon code for 8+2 base, 1 base error, 2 nocall correction
gacttactct

SEQ ID NO: 3389 - DNA, 10 bp, Artificial Sequence
  synthetic Reed-Solomon code for 8+2 base, 1 base error, 2 nocall correction
tccttacttt

SEQ ID NO: 3390 - DNA, 10 bp, Artificial Sequence
  synthetic Reed-Solomon code for 8+2 base, 1 base error, 2 nocall correction
cctttacttc

SEQ ID NO: 3391 - DNA, 10 bp, Artificial Sequence
  synthetic Reed-Solomon code for 8+2 base, 1 base error, 2 nocall correction
agtttactgt

SEQ ID NO: 3392 - DNA, 10 bp, Artificial Sequence
  synthetic Reed-Solomon code for 8+2 base, 1 base error, 2 nocall correction
cttttactga

SEQ ID NO: 3393 - DNA, 10 bp, Artificial Sequence
  synthetic Reed-Solomon code for 8+2 base, 1 base error, 2 nocall correction
cagaacctct

SEQ ID NO: 3394 - DNA, 10 bp, Artificial Sequence
  synthetic Reed-Solomon code for 8+2 base, 1 base error, 2 nocall correction
cctaaccttg

SEQ ID NO: 3395 - DNA, 10 bp, Artificial Sequence
  synthetic Reed-Solomon code for 8+2 base, 1 base error, 2 nocall correction
caccaccttt

SEQ ID NO: 3396 - DNA, 10 bp, Artificial Sequence
  synthetic Reed-Solomon code for 8+2 base, 1 base error, 2 nocall correction
tatcaccttc

SEQ ID NO: 3397 - DNA, 10 bp, Artificial Sequence
  synthetic Reed-Solomon code for 8+2 base, 1 base error, 2 nocall correction
gctcacctcc

SEQ ID NO: 3398 - DNA, 10 bp, Artificial Sequence
  synthetic Reed-Solomon code for 8+2 base, 1 base error, 2 nocall correction
ttagacctgg

SEQ ID NO: 3399 - DNA, 10 bp, Artificial Sequence
  synthetic Reed-Solomon code for 8+2 base, 1 base error, 2 nocall correction
aaggacctcc

SEQ ID NO: 3400 - DNA, 10 bp, Artificial Sequence
  synthetic Reed-Solomon code for 8+2 base, 1 base error, 2 nocall correction
cgtgacctgg

SEQ ID NO: 3401 - DNA, 10 bp, Artificial Sequence
  synthetic Reed-Solomon code for 8+2 base, 1 base error, 2 nocall correction
ggataccttt

SEQ ID NO: 3402 - DNA, 10 bp, Artificial Sequence
  synthetic Reed-Solomon code for 8+2 base, 1 base error, 2 nocall correction
gcctacctga

SEQ ID NO: 3403 - DNA, 10 bp, Artificial Sequence
  synthetic Reed-Solomon code for 8+2 base, 1 base error, 2 nocall correction
gtctaccttc

SEQ ID NO: 3404 - DNA, 10 bp, Artificial Sequence
  synthetic Reed-Solomon code for 8+2 base, 1 base error, 2 nocall correction
ctgtaccttg

SEQ ID NO: 3405 - DNA, 10 bp, Artificial Sequence
  synthetic Reed-Solomon code for 8+2 base, 1 base error, 2 nocall correction
aacacccttt

SEQ ID NO: 3406 - DNA, 10 bp, Artificial Sequence
  synthetic Reed-Solomon code for 8+2 base, 1 base error, 2 nocall correction
tgccccctgg

SEQ ID NO: 3407 - DNA, 10 bp, Artificial Sequence
  synthetic Reed-Solomon code for 8+2 base, 1 base error, 2 nocall correction
aagcccctct

SEQ ID NO: 3408 - DNA, 10 bp, Artificial Sequence
  synthetic Reed-Solomon code for 8+2 base, 1 base error, 2 nocall correction
gatcccctaa

SEQ ID NO: 3409 - DNA, 10 bp, Artificial Sequence
  synthetic Reed-Solomon code for 8+2 base, 1 base error, 2 nocall correction
actccccttg

SEQ ID NO: 3410 - DNA, 10 bp, Artificial Sequence
  synthetic Reed-Solomon code for 8+2 base, 1 base error, 2 nocall correction
aaagccctta

SEQ ID NO: 3411 - DNA, 10 bp, Artificial Sequence
  synthetic Reed-Solomon code for 8+2 base, 1 base error, 2 nocall correction
gcagccctag

SEQ ID NO: 3412 - DNA, 10 bp, Artificial Sequence
  synthetic Reed-Solomon code for 8+2 base, 1 base error, 2 nocall correction
cacgcccttc

SEQ ID NO: 3413 - DNA, 10 bp, Artificial Sequence
  synthetic Reed-Solomon code for 8+2 base, 1 base error, 2 nocall correction
gaggcccttg

SEQ ID NO: 3414 - DNA, 10 bp, Artificial Sequence
  synthetic Reed-Solomon code for 8+2 base, 1 base error, 2 nocall correction
acggccctaa

SEQ ID NO: 3415 - DNA, 10 bp, Artificial Sequence
  synthetic Reed-Solomon code for 8+2 base, 1 base error, 2 nocall correction
tcggccctcg

SEQ ID NO: 3416 - DNA, 10 bp, Artificial Sequence
  synthetic Reed-Solomon code for 8+2 base, 1 base error, 2 nocall correction
tatgcccttt

SEQ ID NO: 3417 - DNA, 10 bp, Artificial Sequence
  synthetic Reed-Solomon code for 8+2 base, 1 base error, 2 nocall correction
gctgccctct

SEQ ID NO: 3418 - DNA, 10 bp, Artificial Sequence
  synthetic Reed-Solomon code for 8+2 base, 1 base error, 2 nocall correction
atctccctcg

SEQ ID NO: 3419 - DNA, 10 bp, Artificial Sequence
  synthetic Reed-Solomon code for 8+2 base, 1 base error, 2 nocall correction
ttctccctaa

SEQ ID NO: 3420 - DNA, 10 bp, Artificial Sequence
  synthetic Reed-Solomon code for 8+2 base, 1 base error, 2 nocall correction
agttccctac

SEQ ID NO: 3421 - DNA, 10 bp, Artificial Sequence
  synthetic Reed-Solomon code for 8+2 base, 1 base error, 2 nocall correction
taaagcctac

SEQ ID NO: 3422 - DNA, 10 bp, Artificial Sequence
  synthetic Reed-Solomon code for 8+2 base, 1 base error, 2 nocall correction
cacagcctcg

SEQ ID NO: 3423 - DNA, 10 bp, Artificial Sequence
  synthetic Reed-Solomon code for 8+2 base, 1 base error, 2 nocall correction
gagagcctcc

SEQ ID NO: 3424 - DNA, 10 bp, Artificial Sequence
  synthetic Reed-Solomon code for 8+2 base, 1 base error, 2 nocall correction
tcgagccttc

SEQ ID NO: 3425 - DNA, 10 bp, Artificial Sequence
  synthetic Reed-Solomon code for 8+2 base, 1 base error, 2 nocall correction
ttgagcctga

SEQ ID NO: 3426 - DNA, 10 bp, Artificial Sequence
  synthetic Reed-Solomon code for 8+2 base, 1 base error, 2 nocall correction
ccacgcctag

SEQ ID NO: 3427 - DNA, 10 bp, Artificial Sequence
  synthetic Reed-Solomon code for 8+2 base, 1 base error, 2 nocall correction
gaccgccttc

SEQ ID NO: 3428 - DNA, 10 bp, Artificial Sequence
  synthetic Reed-Solomon code for 8+2 base, 1 base error, 2 nocall correction
tcccgcctcc

SEQ ID NO: 3429 - DNA, 10 bp, Artificial Sequence
  synthetic Reed-Solomon code for 8+2 base, 1 base error, 2 nocall correction
cagcgccttg

SEQ ID NO: 3430 - DNA, 10 bp, Artificial Sequence
  synthetic Reed-Solomon code for 8+2 base, 1 base error, 2 nocall correction
cctcgcctct

SEQ ID NO: 3431 - DNA, 10 bp, Artificial Sequence
  synthetic Reed-Solomon code for 8+2 base, 1 base error, 2 nocall correction
tggggcctgc

SEQ ID NO: 3432 - DNA, 10 bp, Artificial Sequence
  synthetic Reed-Solomon code for 8+2 base, 1 base error, 2 nocall correction
catggcctaa

SEQ ID NO: 3433 - DNA, 10 bp, Artificial Sequence
  synthetic Reed-Solomon code for 8+2 base, 1 base error, 2 nocall correction
acatgcctgt

SEQ ID NO: 3434 - DNA, 10 bp, Artificial Sequence
  synthetic Reed-Solomon code for 8+2 base, 1 base error, 2 nocall correction
cgatgccttc

SEQ ID NO: 3435 - DNA, 10 bp, Artificial Sequence
  synthetic Reed-Solomon code for 8+2 base, 1 base error, 2 nocall correction
agctgcctta

SEQ ID NO: 3436 - DNA, 10 bp, Artificial Sequence
  synthetic Reed-Solomon code for 8+2 base, 1 base error, 2 nocall correction
ctctgccttt

SEQ ID NO: 3437 - DNA, 10 bp, Artificial Sequence
  synthetic Reed-Solomon code for 8+2 base, 1 base error, 2 nocall correction
tcttgcctga

SEQ ID NO: 3438 - DNA, 10 bp, Artificial Sequence
  synthetic Reed-Solomon code for 8+2 base, 1 base error, 2 nocall correction
ttttgccttc

SEQ ID NO: 3439 - DNA, 10 bp, Artificial Sequence
  synthetic Reed-Solomon code for 8+2 base, 1 base error, 2 nocall correction
ggtatcctta

SEQ ID NO: 3440 - DNA, 10 bp, Artificial Sequence
  synthetic Reed-Solomon code for 8+2 base, 1 base error, 2 nocall correction
gaactcctgg

SEQ ID NO: 3441 - DNA, 10 bp, Artificial Sequence
  synthetic Reed-Solomon code for 8+2 base, 1 base error, 2 nocall correction
atactcctac

SEQ ID NO: 3442 - DNA, 10 bp, Artificial Sequence
  synthetic Reed-Solomon code for 8+2 base, 1 base error, 2 nocall correction
agcctcctat

SEQ ID NO: 3443 - DNA, 10 bp, Artificial Sequence
  synthetic Reed-Solomon code for 8+2 base, 1 base error, 2 nocall correction
ctcctcctaa

SEQ ID NO: 3444 - DNA, 10 bp, Artificial Sequence
  synthetic Reed-Solomon code for 8+2 base, 1 base error, 2 nocall correction
aagctcctga

SEQ ID NO: 3445 - DNA, 10 bp, Artificial Sequence
  synthetic Reed-Solomon code for 8+2 base, 1 base error, 2 nocall correction
gctgtcctga

SEQ ID NO: 3446 - DNA, 10 bp, Artificial Sequence
  synthetic Reed-Solomon code for 8+2 base, 1 base error, 2 nocall correction
gttgtccttc

SEQ ID NO: 3447 - DNA, 10 bp, Artificial Sequence
  synthetic Reed-Solomon code for 8+2 base, 1 base error, 2 nocall correction
cgcttcctgg

SEQ ID NO: 3448 - DNA, 10 bp, Artificial Sequence
  synthetic Reed-Solomon code for 8+2 base, 1 base error, 2 nocall correction
gggttcctgc

SEQ ID NO: 3449 - DNA, 10 bp, Artificial Sequence
  synthetic Reed-Solomon code for 8+2 base, 1 base error, 2 nocall correction
agaaagctag

SEQ ID NO: 3450 - DNA, 10 bp, Artificial Sequence
  synthetic Reed-Solomon code for 8+2 base, 1 base error, 2 nocall correction
tgaaagctca

SEQ ID NO: 3451 - DNA, 10 bp, Artificial Sequence
  synthetic Reed-Solomon code for 8+2 base, 1 base error, 2 nocall correction
gacaagctgt

SEQ ID NO: 3452 - DNA, 10 bp, Artificial Sequence
  synthetic Reed-Solomon code for 8+2 base, 1 base error, 2 nocall correction
gggaagctaa

SEQ ID NO: 3453 - DNA, 10 bp, Artificial Sequence
  synthetic Reed-Solomon code for 8+2 base, 1 base error, 2 nocall correction
agtaagctct

SEQ ID NO: 3454 - DNA, 10 bp, Artificial Sequence
  synthetic Reed-Solomon code for 8+2 base, 1 base error, 2 nocall correction
cttaagctca

SEQ ID NO: 3455 - DNA, 10 bp, Artificial Sequence
  synthetic Reed-Solomon code for 8+2 base, 1 base error, 2 nocall correction
tcgcagctgt

SEQ ID NO: 3456 - DNA, 10 bp, Artificial Sequence
  synthetic Reed-Solomon code for 8+2 base, 1 base error, 2 nocall correction
gctcagctgg

SEQ ID NO: 3457 - DNA, 10 bp, Artificial Sequence
  synthetic Reed-Solomon code for 8+2 base, 1 base error, 2 nocall correction
gaagagctga

SEQ ID NO: 3458 - DNA, 10 bp, Artificial Sequence
  synthetic Reed-Solomon code for 8+2 base, 1 base error, 2 nocall correction
ttagagctcc

SEQ ID NO: 3459 - DNA, 10 bp, Artificial Sequence
  synthetic Reed-Solomon code for 8+2 base, 1 base error, 2 nocall correction
tgcgagctct

SEQ ID NO: 3460 - DNA, 10 bp, Artificial Sequence
  synthetic Reed-Solomon code for 8+2 base, 1 base error, 2 nocall correction
ctcgagctag

SEQ ID NO: 3461 - DNA, 10 bp, Artificial Sequence
  synthetic Reed-Solomon code for 8+2 base, 1 base error, 2 nocall correction
aaggagctgg

SEQ ID NO: 3462 - DNA, 10 bp, Artificial Sequence
  synthetic Reed-Solomon code for 8+2 base, 1 base error, 2 nocall correction
gtggagctac

SEQ ID NO: 3463 - DNA, 10 bp, Artificial Sequence
  synthetic Reed-Solomon code for 8+2 base, 1 base error, 2 nocall correction
cgtgagctcc

SEQ ID NO: 3464 - DNA, 10 bp, Artificial Sequence
  synthetic Reed-Solomon code for 8+2 base, 1 base error, 2 nocall correction
ccgtagctca

SEQ ID NO: 3465 - DNA, 10 bp, Artificial Sequence
  synthetic Reed-Solomon code for 8+2 base, 1 base error, 2 nocall correction
tggacgcttc

SEQ ID NO: 3466 - DNA, 10 bp, Artificial Sequence
  synthetic Reed-Solomon code for 8+2 base, 1 base error, 2 nocall correction
cgaccgctag

SEQ ID NO: 3467 - DNA, 10 bp, Artificial Sequence
  synthetic Reed-Solomon code for 8+2 base, 1 base error, 2 nocall correction
ttaccgctct

SEQ ID NO: 3468 - DNA, 10 bp, Artificial Sequence
  synthetic Reed-Solomon code for 8+2 base, 1 base error, 2 nocall correction
tgcccgctcc

SEQ ID NO: 3469 - DNA, 10 bp, Artificial Sequence
  synthetic Reed-Solomon code for 8+2 base, 1 base error, 2 nocall correction
gtgccgctat

SEQ ID NO: 3470 - DNA, 10 bp, Artificial Sequence
  synthetic Reed-Solomon code for 8+2 base, 1 base error, 2 nocall correction
cgtccgctct

SEQ ID NO: 3471 - DNA, 10 bp, Artificial Sequence
  synthetic Reed-Solomon code for 8+2 base, 1 base error, 2 nocall correction
attccgctca

SEQ ID NO: 3472 - DNA, 10 bp, Artificial Sequence
  synthetic Reed-Solomon code for 8+2 base, 1 base error, 2 nocall correction
tttccgctag

SEQ ID NO: 3473 - DNA, 10 bp, Artificial Sequence
  synthetic Reed-Solomon code for 8+2 base, 1 base error, 2 nocall correction
tcggcgctgc

SEQ ID NO: 3474 - DNA, 10 bp, Artificial Sequence
  synthetic Reed-Solomon code for 8+2 base, 1 base error, 2 nocall correction
ttggcgctta

SEQ ID NO: 3475 - DNA, 10 bp, Artificial Sequence
  synthetic Reed-Solomon code for 8+2 base, 1 base error, 2 nocall correction
ccatcgcttc

SEQ ID NO: 3476 - DNA, 10 bp, Artificial Sequence
  synthetic Reed-Solomon code for 8+2 base, 1 base error, 2 nocall correction
agatcgctgt

SEQ ID NO: 3477 - DNA, 10 bp, Artificial Sequence
  synthetic Reed-Solomon code for 8+2 base, 1 base error, 2 nocall correction
ctatcgctga

SEQ ID NO: 3478 - DNA, 10 bp, Artificial Sequence
  synthetic Reed-Solomon code for 8+2 base, 1 base error, 2 nocall correction
gactcgctag

SEQ ID NO: 3479 - DNA, 10 bp, Artificial Sequence
  synthetic Reed-Solomon code for 8+2 base, 1 base error, 2 nocall correction
acctcgctta

SEQ ID NO: 3480 - DNA, 10 bp, Artificial Sequence
  synthetic Reed-Solomon code for 8+2 base, 1 base error, 2 nocall correction
atctcgctgc

SEQ ID NO: 3481 - DNA, 10 bp, Artificial Sequence
  synthetic Reed-Solomon code for 8+2 base, 1 base error, 2 nocall correction
cagtcgctac

SEQ ID NO: 3482 - DNA, 10 bp, Artificial Sequence
  synthetic Reed-Solomon code for 8+2 base, 1 base error, 2 nocall correction
tgttcgctga

SEQ ID NO: 3483 - DNA, 10 bp, Artificial Sequence
  synthetic Reed-Solomon code for 8+2 base, 1 base error, 2 nocall correction
aaaaggctga

SEQ ID NO: 3484 - DNA, 10 bp, Artificial Sequence
  synthetic Reed-Solomon code for 8+2 base, 1 base error, 2 nocall correction
cacaggctgc

SEQ ID NO: 3485 - DNA, 10 bp, Artificial Sequence
  synthetic Reed-Solomon code for 8+2 base, 1 base error, 2 nocall correction
gagaggctgg

SEQ ID NO: 3486 - DNA, 10 bp, Artificial Sequence
  synthetic Reed-Solomon code for 8+2 base, 1 base error, 2 nocall correction
atgaggctac

SEQ ID NO: 3487 - DNA, 10 bp, Artificial Sequence
  synthetic Reed-Solomon code for 8+2 base, 1 base error, 2 nocall correction
tataggctgt

SEQ ID NO: 3488 - DNA, 10 bp, Artificial Sequence
  synthetic Reed-Solomon code for 8+2 base, 1 base error, 2 nocall correction
tcccggctgg

SEQ ID NO: 3489 - DNA, 10 bp, Artificial Sequence
  synthetic Reed-Solomon code for 8+2 base, 1 base error, 2 nocall correction
agtcggcttg

SEQ ID NO: 3490 - DNA, 10 bp, Artificial Sequence
  synthetic Reed-Solomon code for 8+2 base, 1 base error, 2 nocall correction
ggagggctag

SEQ ID NO: 3491 - DNA, 10 bp, Artificial Sequence
  synthetic Reed-Solomon code for 8+2 base, 1 base error, 2 nocall correction
aacgggctgt

SEQ ID NO: 3492 - DNA, 10 bp, Artificial Sequence
  synthetic Reed-Solomon code for 8+2 base, 1 base error, 2 nocall correction
agggggctaa

SEQ ID NO: 3493 - DNA, 10 bp, Artificial Sequence
  synthetic Reed-Solomon code for 8+2 base, 1 base error, 2 nocall correction
tgggggctcg

SEQ ID NO: 3494 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
ctggggctat

SEQ ID NO: 3495 - DNA, 10 bp, Artificial Sequence
  synthetic Reed-Solomon code for 8+2 base, 1 base error, 2 nocall correction
ggtgggctct

SEQ ID NO: 3496 - DNA, 10 bp, Artificial Sequence
  synthetic Reed-Solomon code for 8+2 base, 1 base error, 2 nocall correction
acttggctac

SEQ ID NO: 3497 - DNA, 10 bp, Artificial Sequence
  synthetic Reed-Solomon code for 8+2 base, 1 base error, 2 nocall correction
caaatgcttg

SEQ ID NO: 3498 - DNA, 10 bp, Artificial Sequence
  synthetic Reed-Solomon code for 8+2 base, 1 base error, 2 nocall correction
gccatgctac

SEQ ID NO: 3499 - DNA, 10 bp, Artificial Sequence
  synthetic Reed-Solomon code for 8+2 base, 1 base error, 2 nocall correction
ccgatgctag

SEQ ID NO: 3500 - DNA, 10 bp, Artificial Sequence
  synthetic Reed-Solomon code for 8+2 base, 1 base error, 2 nocall correction
gaactgctcc

SEQ ID NO: 3501 - DNA, 10 bp, Artificial Sequence
  synthetic Reed-Solomon code for 8+2 base, 1 base error, 2 nocall correction
tcactgcttc

SEQ ID NO: 3502 - DNA, 10 bp, Artificial Sequence
  synthetic Reed-Solomon code for 8+2 base, 1 base error, 2 nocall correction
ttactgctga

SEQ ID NO: 3503 - DNA, 10 bp, Artificial Sequence
  synthetic Reed-Solomon code for 8+2 base, 1 base error, 2 nocall correction
tagctgctac

SEQ ID NO: 3504 - DNA, 10 bp, Artificial Sequence
  synthetic Reed-Solomon code for 8+2 base, 1 base error, 2 nocall correction
cgtctgctga

SEQ ID NO: 3505 - DNA, 10 bp, Artificial Sequence
  synthetic Reed-Solomon code for 8+2 base, 1 base error, 2 nocall correction
attctgctgt

SEQ ID NO: 3506 - DNA, 10 bp, Artificial Sequence
  synthetic Reed-Solomon code for 8+2 base, 1 base error, 2 nocall correction
agattgctca

SEQ ID NO: 3507 - DNA, 10 bp, Artificial Sequence
  synthetic Reed-Solomon code for 8+2 base, 1 base error, 2 nocall correction
tgattgctag

SEQ ID NO: 3508 - DNA, 10 bp, Artificial Sequence
  synthetic Reed-Solomon code for 8+2 base, 1 base error, 2 nocall correction
ctattgctct

SEQ ID NO: 3509 - DNA, 10 bp, Artificial Sequence
  synthetic Reed-Solomon code for 8+2 base, 1 base error, 2 nocall correction
cgcttgctcc

SEQ ID NO: 3510 - DNA, 10 bp, Artificial Sequence
  synthetic Reed-Solomon code for 8+2 base, 1 base error, 2 nocall correction
gggttgctcg

SEQ ID NO: 3511 - DNA, 10 bp, Artificial Sequence
  synthetic Reed-Solomon code for 8+2 base, 1 base error, 2 nocall correction
tgtttgctct

SEQ ID NO: 3512 - DNA, 10 bp, Artificial Sequence
  synthetic Reed-Solomon code for 8+2 base, 1 base error, 2 nocall correction
cttttgctag

SEQ ID NO: 3513 - DNA, 10 bp, Artificial Sequence
  synthetic Reed-Solomon code for 8+2 base, 1 base error, 2 nocall correction
ccaaatctac

SEQ ID NO: 3514 - DNA, 10 bp, Artificial Sequence
  synthetic Reed-Solomon code for 8+2 base, 1 base error, 2 nocall correction
gacaatcttg

SEQ ID NO: 3515 - DNA, 10 bp, Artificial Sequence
  synthetic Reed-Solomon code for 8+2 base, 1 base error, 2 nocall correction
accaatctaa

SEQ ID NO: 3516 - DNA, 10 bp, Artificial Sequence
  synthetic Reed-Solomon code for 8+2 base, 1 base error, 2 nocall correction
tccaatctcg

SEQ ID NO: 3517 - DNA, 10 bp, Artificial Sequence
  synthetic Reed-Solomon code for 8+2 base, 1 base error, 2 nocall correction
cagaatcttc

SEQ ID NO: 3518 - DNA, 10 bp, Artificial Sequence
  synthetic Reed-Solomon code for 8+2 base, 1 base error, 2 nocall correction
aaacatctca

SEQ ID NO: 3519 - DNA, 10 bp, Artificial Sequence
  synthetic Reed-Solomon code for 8+2 base, 1 base error, 2 nocall correction
taacatctag

SEQ ID NO: 3520 - DNA, 10 bp, Artificial Sequence
  synthetic Reed-Solomon code for 8+2 base, 1 base error, 2 nocall correction
caccatctcc

SEQ ID NO: 3521 - DNA, 10 bp, Artificial Sequence
  synthetic Reed-Solomon code for 8+2 base, 1 base error, 2 nocall correction
gagcatctcg

SEQ ID NO: 3522 - DNA, 10 bp, Artificial Sequence
  synthetic Reed-Solomon code for 8+2 base, 1 base error, 2 nocall correction
tcgcatcttg

SEQ ID NO: 3523 - DNA, 10 bp, Artificial Sequence
  synthetic Reed-Solomon code for 8+2 base, 1 base error, 2 nocall correction
tatcatctct

SEQ ID NO: 3524 - DNA, 10 bp, Artificial Sequence
  synthetic Reed-Solomon code for 8+2 base, 1 base error, 2 nocall correction
gctcatcttt

SEQ ID NO: 3525 - DNA, 10 bp, Artificial Sequence
  synthetic Reed-Solomon code for 8+2 base, 1 base error, 2 nocall correction
acagatctat

SEQ ID NO: 3526 - DNA, 10 bp, Artificial Sequence
  synthetic Reed-Solomon code for 8+2 base, 1 base error, 2 nocall correction
aaggatcttt

SEQ ID NO: 3527 - DNA, 10 bp, Artificial Sequence
  synthetic Reed-Solomon code for 8+2 base, 1 base error, 2 nocall correction
actgatctcg

SEQ ID NO: 3528 - DNA, 10 bp, Artificial Sequence
  synthetic Reed-Solomon code for 8+2 base, 1 base error, 2 nocall correction
tctgatctaa

SEQ ID NO: 3529 - DNA, 10 bp, Artificial Sequence
  synthetic Reed-Solomon code for 8+2 base, 1 base error, 2 nocall correction
ggatatctcc

SEQ ID NO: 3530 - DNA, 10 bp, Artificial Sequence
  synthetic Reed-Solomon code for 8+2 base, 1 base error, 2 nocall correction
gtctatctct

SEQ ID NO: 3531 - DNA, 10 bp, Artificial Sequence
  synthetic Reed-Solomon code for 8+2 base, 1 base error, 2 nocall correction
tggtatctac

SEQ ID NO: 3532 - DNA, 10 bp, Artificial Sequence
  synthetic Reed-Solomon code for 8+2 base, 1 base error, 2 nocall correction
cattatctga

SEQ ID NO: 3533 - DNA, 10 bp, Artificial Sequence
  synthetic Reed-Solomon code for 8+2 base, 1 base error, 2 nocall correction
caaactctca

SEQ ID NO: 3534 - DNA, 10 bp, Artificial Sequence
  synthetic Reed-Solomon code for 8+2 base, 1 base error, 2 nocall correction
aacactctcc

SEQ ID NO: 3535 - DNA, 10 bp, Artificial Sequence
  synthetic Reed-Solomon code for 8+2 base, 1 base error, 2 nocall correction
ggtactctgc

SEQ ID NO: 3536 - DNA, 10 bp, Artificial Sequence
  synthetic Reed-Solomon code for 8+2 base, 1 base error, 2 nocall correction
acacctctac

SEQ ID NO: 3537 - DNA, 10 bp, Artificial Sequence
  synthetic Reed-Solomon code for 8+2 base, 1 base error, 2 nocall correction
ccccctctaa

SEQ ID NO: 3538 - DNA, 10 bp, Artificial Sequence
  synthetic Reed-Solomon code for 8+2 base, 1 base error, 2 nocall correction
aagcctcttc

SEQ ID NO: 3539 - DNA, 10 bp, Artificial Sequence
  synthetic Reed-Solomon code for 8+2 base, 1 base error, 2 nocall correction
cacgctctct

SEQ ID NO: 3540 - DNA, 10 bp, Artificial Sequence
  synthetic Reed-Solomon code for 8+2 base, 1 base error, 2 nocall correction
tatgctctcc

SEQ ID NO: 3541 - DNA, 10 bp, Artificial Sequence
  synthetic Reed-Solomon code for 8+2 base, 1 base error, 2 nocall correction
gctgctcttc

SEQ ID NO: 3542 - DNA, 10 bp, Artificial Sequence
  synthetic Reed-Solomon code for 8+2 base, 1 base error, 2 nocall correction
gttgctctga

SEQ ID NO: 3543 - DNA, 10 bp, Artificial Sequence
  synthetic Reed-Solomon code for 8+2 base, 1 base error, 2 nocall correction
agatctcttg

SEQ ID NO: 3544 - DNA, 10 bp, Artificial Sequence
  synthetic Reed-Solomon code for 8+2 base, 1 base error, 2 nocall correction
gggtctctta

SEQ ID NO: 3545 - DNA, 10 bp, Artificial Sequence
  synthetic Reed-Solomon code for 8+2 base, 1 base error, 2 nocall correction
gcaagtctat

SEQ ID NO: 3546 - DNA, 10 bp, Artificial Sequence
  synthetic Reed-Solomon code for 8+2 base, 1 base error, 2 nocall correction
gagagtcttt

SEQ ID NO: 3547 - DNA, 10 bp, Artificial Sequence
  synthetic Reed-Solomon code for 8+2 base, 1 base error, 2 nocall correction
tcgagtctct

SEQ ID NO: 3548 - DNA, 10 bp, Artificial Sequence
  synthetic Reed-Solomon code for 8+2 base, 1 base error, 2 nocall correction
tatagtcttg

SEQ ID NO: 3549 - DNA, 10 bp, Artificial Sequence
  synthetic Reed-Solomon code for 8+2 base, 1 base error, 2 nocall correction
gctagtctcg

SEQ ID NO: 3550 - DNA, 10 bp, Artificial Sequence
  synthetic Reed-Solomon code for 8+2 base, 1 base error, 2 nocall correction
tgacgtctga

SEQ ID NO: 3551 - DNA, 10 bp, Artificial Sequence
  synthetic Reed-Solomon code for 8+2 base, 1 base error, 2 nocall correction
gaccgtctct

SEQ ID NO: 3552 - DNA, 10 bp, Artificial Sequence
  synthetic Reed-Solomon code for 8+2 base, 1 base error, 2 nocall correction
tcccgtcttt

SEQ ID NO: 3553 - DNA, 10 bp, Artificial Sequence
  synthetic Reed-Solomon code for 8+2 base, 1 base error, 2 nocall correction
cctcgtcttc

SEQ ID NO: 3554 - DNA, 10 bp, Artificial Sequence
  synthetic Reed-Solomon code for 8+2 base, 1 base error, 2 nocall correction
agtcgtctgt

SEQ ID NO: 3555 - DNA, 10 bp, Artificial Sequence
  synthetic Reed-Solomon code for 8+2 base, 1 base error, 2 nocall correction
cttcgtctga

SEQ ID NO: 3556 - DNA, 10 bp, Artificial Sequence
  synthetic Reed-Solomon code for 8+2 base, 1 base error, 2 nocall correction
aacggtcttg

SEQ ID NO: 3557 - DNA, 10 bp, Artificial Sequence
  synthetic Reed-Solomon code for 8+2 base, 1 base error, 2 nocall correction
gccggtctaa

SEQ ID NO: 3558 - DNA, 10 bp, Artificial Sequence
  synthetic Reed-Solomon code for 8+2 base, 1 base error, 2 nocall correction
cgatgtctct

SEQ ID NO: 3559 - DNA, 10 bp, Artificial Sequence
  synthetic Reed-Solomon code for 8+2 base, 1 base error, 2 nocall correction
atatgtctca

SEQ ID NO: 3560 - DNA, 10 bp, Artificial Sequence
  synthetic Reed-Solomon code for 8+2 base, 1 base error, 2 nocall correction
ttatgtctag

SEQ ID NO: 3561 - DNA, 10 bp, Artificial Sequence
  synthetic Reed-Solomon code for 8+2 base, 1 base error, 2 nocall correction
ctctgtctcc

SEQ ID NO: 3562 - DNA, 10 bp, Artificial Sequence
  synthetic Reed-Solomon code for 8+2 base, 1 base error, 2 nocall correction
gtgtgtctcg

SEQ ID NO: 3563 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
cgttgtctag

SEQ ID NO: 3564 - DNA, 10 bp, Artificial Sequence
  synthetic Reed-Solomon code for 8+2 base, 1 base error, 2 nocall correction
ttttgtctct

SEQ ID NO: 3565 - DNA, 10 bp, Artificial Sequence
  synthetic Reed-Solomon code for 8+2 base, 1 base error, 2 nocall correction
caaattctgt

SEQ ID NO: 3566 - DNA, 10 bp, Artificial Sequence
  synthetic Reed-Solomon code for 8+2 base, 1 base error, 2 nocall correction
aggattctac

SEQ ID NO: 3567 - DNA, 10 bp, Artificial Sequence
  synthetic Reed-Solomon code for 8+2 base, 1 base error, 2 nocall correction
attcttcttg

SEQ ID NO: 3568 - DNA, 10 bp, Artificial Sequence
  synthetic Reed-Solomon code for 8+2 base, 1 base error, 2 nocall correction
aaagttctgc

SEQ ID NO: 3569 - DNA, 10 bp, Artificial Sequence
  synthetic Reed-Solomon code for 8+2 base, 1 base error, 2 nocall correction
gtagttctag

SEQ ID NO: 3570 - DNA, 10 bp, Artificial Sequence
  synthetic Reed-Solomon code for 8+2 base, 1 base error, 2 nocall correction
cacgttctga

SEQ ID NO: 3571 - DNA, 10 bp, Artificial Sequence
  synthetic Reed-Solomon code for 8+2 base, 1 base error, 2 nocall correction
cgggttctat

SEQ ID NO: 3572 - DNA, 10 bp, Artificial Sequence
  synthetic Reed-Solomon code for 8+2 base, 1 base error, 2 nocall correction
atggttctaa

SEQ ID NO: 3573 - DNA, 10 bp, Artificial Sequence
  synthetic Reed-Solomon code for 8+2 base, 1 base error, 2 nocall correction
ttggttctcg

SEQ ID NO: 3574 - DNA, 10 bp, Artificial Sequence
  synthetic Reed-Solomon code for 8+2 base, 1 base error, 2 nocall correction
gttgttctct

SEQ ID NO: 3575 - DNA, 10 bp, Artificial Sequence
  synthetic Reed-Solomon code for 8+2 base, 1 base error, 2 nocall correction
acctttctcg

SEQ ID NO: 3576 - DNA, 10 bp, Artificial Sequence
  synthetic Reed-Solomon code for 8+2 base, 1 base error, 2 nocall correction
tcctttctaa

SEQ ID NO: 3577 - DNA, 10 bp, Artificial Sequence
  synthetic Reed-Solomon code for 8+2 base, 1 base error, 2 nocall correction
gtaaaagtct

SEQ ID NO: 3578 - DNA, 10 bp, Artificial Sequence
  synthetic Reed-Solomon code for 8+2 base, 1 base error, 2 nocall correction
ggcaaagtcc

SEQ ID NO: 3579 - DNA, 10 bp, Artificial Sequence
  synthetic Reed-Solomon code for 8+2 base, 1 base error, 2 nocall correction
cggaaagtcg

SEQ ID NO: 3580 - DNA, 10 bp, Artificial Sequence
  synthetic Reed-Solomon code for 8+2 base, 1 base error, 2 nocall correction
ttgaaagtat

SEQ ID NO: 3581 - DNA, 10 bp, Artificial Sequence
  synthetic Reed-Solomon code for 8+2 base, 1 base error, 2 nocall correction
aataaagtgc

SEQ ID NO: 3582 - DNA, 10 bp, Artificial Sequence
  synthetic Reed-Solomon code for 8+2 base, 1 base error, 2 nocall correction
gttaaagtag

SEQ ID NO: 3583 - DNA, 10 bp, Artificial Sequence
  synthetic Reed-Solomon code for 8+2 base, 1 base error, 2 nocall correction
cgccaagttg

SEQ ID NO: 3584 - DNA, 10 bp, Artificial Sequence
  synthetic Reed-Solomon code for 8+2 base, 1 base error, 2 nocall correction
gggcaagttc

SEQ ID NO: 3585 - DNA, 10 bp, Artificial Sequence
  synthetic Reed-Solomon code for 8+2 base, 1 base error, 2 nocall correction
tacgaagtgc

SEQ ID NO: 3586 - DNA, 10 bp, Artificial Sequence
  synthetic Reed-Solomon code for 8+2 base, 1 base error, 2 nocall correction
gtcgaagtca

SEQ ID NO: 3587 - DNA, 10 bp, Artificial Sequence
  synthetic Reed-Solomon code for 8+2 base, 1 base error, 2 nocall correction
catgaagtgt

SEQ ID NO: 3588 - DNA, 10 bp, Artificial Sequence
  synthetic Reed-Solomon code for 8+2 base, 1 base error, 2 nocall correction
gaataagttg

SEQ ID NO: 3589 - DNA, 10 bp, Artificial Sequence
  synthetic Reed-Solomon code for 8+2 base, 1 base error, 2 nocall correction
acataagtaa

SEQ ID NO: 3590 - DNA, 10 bp, Artificial Sequence
  synthetic Reed-Solomon code for 8+2 base, 1 base error, 2 nocall correction
tcataagtcg

SEQ ID NO: 3591 - DNA, 10 bp, Artificial Sequence
  synthetic Reed-Solomon code for 8+2 base, 1 base error, 2 nocall correction
ccctaagtac

SEQ ID NO: 3592 - DNA, 10 bp, Artificial Sequence
  synthetic Reed-Solomon code for 8+2 base, 1 base error, 2 nocall correction
aagtaagtta

SEQ ID NO: 3593 - DNA, 10 bp, Artificial Sequence
  synthetic Reed-Solomon code for 8+2 base, 1 base error, 2 nocall correction
gcgtaagtag

SEQ ID NO: 3594 - DNA, 10 bp, Artificial Sequence
  synthetic Reed-Solomon code for 8+2 base, 1 base error, 2 nocall correction
tcttaagtat

SEQ ID NO: 3595 - DNA, 10 bp, Artificial Sequence
  synthetic Reed-Solomon code for 8+2 base, 1 base error, 2 nocall correction
agcacagttg

SEQ ID NO: 3596 - DNA, 10 bp, Artificial Sequence
  synthetic Reed-Solomon code for 8+2 base, 1 base error, 2 nocall correction
gcgacagtgt

SEQ ID NO: 3597 - DNA, 10 bp, Artificial Sequence
  synthetic Reed-Solomon code for 8+2 base, 1 base error, 2 nocall correction
tctacagtgg

SEQ ID NO: 3598 - DNA, 10 bp, Artificial Sequence
  synthetic Reed-Solomon code for 8+2 base, 1 base error, 2 nocall correction
ggaccagtca

SEQ ID NO: 3599 - DNA, 10 bp, Artificial Sequence
  synthetic Reed-Solomon code for 8+2 base, 1 base error, 2 nocall correction
tacccagtgt

SEQ ID NO: 3600 - DNA, 10 bp, Artificial Sequence
  synthetic Reed-Solomon code for 8+2 base, 1 base error, 2 nocall correction
aggccagtcg

SEQ ID NO: 3601 - DNA, 10 bp, Artificial Sequence
  synthetic Reed-Solomon code for 8+2 base, 1 base error, 2 nocall correction
tggccagtaa

SEQ ID NO: 3602 - DNA, 10 bp, Artificial Sequence
  synthetic Reed-Solomon code for 8+2 base, 1 base error, 2 nocall correction
catccagtgc

SEQ ID NO: 3603 - DNA, 10 bp, Artificial Sequence
  synthetic Reed-Solomon code for 8+2 base, 1 base error, 2 nocall correction
ctagcagttg

SEQ ID NO: 3604 - DNA, 10 bp, Artificial Sequence
  synthetic Reed-Solomon code for 8+2 base, 1 base error, 2 nocall correction
accgcagtgg

SEQ ID NO: 3605 - DNA, 10 bp, Artificial Sequence
  synthetic Reed-Solomon code for 8+2 base, 1 base error, 2 nocall correction
ggggcagttt

SEQ ID NO: 3606 - DNA, 10 bp, Artificial Sequence
  synthetic Reed-Solomon code for 8+2 base, 1 base error, 2 nocall correction
tgtgcagttg

SEQ ID NO: 3607 - DNA, 10 bp, Artificial Sequence
  synthetic Reed-Solomon code for 8+2 base, 1 base error, 2 nocall correction
aaatcagtcc

SEQ ID NO: 3608 - DNA, 10 bp, Artificial Sequence
  synthetic Reed-Solomon code for 8+2 base, 1 base error, 2 nocall correction
cactcagtca

SEQ ID NO: 3609 - DNA, 10 bp, Artificial Sequence
  synthetic Reed-Solomon code for 8+2 base, 1 base error, 2 nocall correction
ttgtcagtgg

SEQ ID NO: 3610 - DNA, 10 bp, Artificial Sequence
  synthetic Reed-Solomon code for 8+2 base, 1 base error, 2 nocall correction
gtttcagtgt

SEQ ID NO: 3611 - DNA, 10 bp, Artificial Sequence
  synthetic Reed-Solomon code for 8+2 base, 1 base error, 2 nocall correction
ctaagagtcc

SEQ ID NO: 3612 - DNA, 10 bp, Artificial Sequence
  synthetic Reed-Solomon code for 8+2 base, 1 base error, 2 nocall correction
cgcagagtct

SEQ ID NO: 3613 - DNA, 10 bp, Artificial Sequence
  synthetic Reed-Solomon code for 8+2 base, 1 base error, 2 nocall correction
atcagagtca

SEQ ID NO: 3614 - DNA, 10 bp, Artificial Sequence
  synthetic Reed-Solomon code for 8+2 base, 1 base error, 2 nocall correction
ttcagagtag

SEQ ID NO: 3615 - DNA, 10 bp, Artificial Sequence
  synthetic Reed-Solomon code for 8+2 base, 1 base error, 2 nocall correction
tgtagagtcc

SEQ ID NO: 3616 - DNA, 10 bp, Artificial Sequence
  synthetic Reed-Solomon code for 8+2 base, 1 base error, 2 nocall correction
gtacgagttg

SEQ ID NO: 3617 - DNA, 10 bp, Artificial Sequence
  synthetic Reed-Solomon code for 8+2 base, 1 base error, 2 nocall correction
acgcgagtgc

SEQ ID NO: 3618 - DNA, 10 bp, Artificial Sequence
  synthetic Reed-Solomon code for 8+2 base, 1 base error, 2 nocall correction
cggcgagttt

SEQ ID NO: 3619 - DNA, 10 bp, Artificial Sequence
  synthetic Reed-Solomon code for 8+2 base, 1 base error, 2 nocall correction
atgcgagtta

SEQ ID NO: 3620 - DNA, 10 bp, Artificial Sequence
  synthetic Reed-Solomon code for 8+2 base, 1 base error, 2 nocall correction
cgaggagtca

SEQ ID NO: 3621 - DNA, 10 bp, Artificial Sequence
  synthetic Reed-Solomon code for 8+2 base, 1 base error, 2 nocall correction
ataggagtct

SEQ ID NO: 3622 - DNA, 10 bp, Artificial Sequence
  synthetic Reed-Solomon code for 8+2 base, 1 base error, 2 nocall correction
agcggagtcc

SEQ ID NO: 3623 - DNA, 10 bp, Artificial Sequence
  synthetic Reed-Solomon code for 8+2 base, 1 base error, 2 nocall correction
gatggagtgc

SEQ ID NO: 3624 - DNA, 10 bp, Artificial Sequence
  synthetic Reed-Solomon code for 8+2 base, 1 base error, 2 nocall correction
attggagtag

SEQ ID NO: 3625 - DNA, 10 bp, Artificial Sequence
  synthetic Reed-Solomon code for 8+2 base, 1 base error, 2 nocall correction
tttggagtca

SEQ ID NO: 3626 - DNA, 10 bp, Artificial Sequence
  synthetic Reed-Solomon code for 8+2 base, 1 base error, 2 nocall correction
gcctgagtat

SEQ ID NO: 3627 - DNA, 10 bp, Artificial Sequence
  synthetic Reed-Solomon code for 8+2 base, 1 base error, 2 nocall correction
acaatagtcg

SEQ ID NO: 3628 - DNA, 10 bp, Artificial Sequence
  synthetic Reed-Solomon code for 8+2 base, 1 base error, 2 nocall correction
tcaatagtaa

SEQ ID NO: 3629 - DNA, 10 bp, Artificial Sequence
  synthetic Reed-Solomon code for 8+2 base, 1 base error, 2 nocall correction
tagatagtta

SEQ ID NO: 3630 - DNA, 10 bp, Artificial Sequence
  synthetic Reed-Solomon code for 8+2 base, 1 base error, 2 nocall correction
gcgatagtca

SEQ ID NO: 3631 - DNA, 10 bp, Artificial Sequence
  synthetic Reed-Solomon code for 8+2 base, 1 base error, 2 nocall correction
actatagtat

SEQ ID NO: 3632 - DNA, 10 bp, Artificial Sequence
  synthetic Reed-Solomon code for 8+2 base, 1 base error, 2 nocall correction
ggactagtgt

SEQ ID NO: 3633 - DNA, 10 bp, Artificial Sequence
  synthetic Reed-Solomon code for 8+2 base, 1 base error, 2 nocall correction
aacctagtag

SEQ ID NO: 3634 - DNA, 10 bp, Artificial Sequence
  synthetic Reed-Solomon code for 8+2 base, 1 base error, 2 nocall correction
tacctagtca

SEQ ID NO: 3635 - DNA, 10 bp, Artificial Sequence
  synthetic Reed-Solomon code for 8+2 base, 1 base error, 2 nocall correction
gccctagtta

SEQ ID NO: 3636 - DNA, 10 bp, Artificial Sequence
  synthetic Reed-Solomon code for 8+2 base, 1 base error, 2 nocall correction
gtcctagtgc

SEQ ID NO: 3637 - DNA, 10 bp, Artificial Sequence
  synthetic Reed-Solomon code for 8+2 base, 1 base error, 2 nocall correction
ctgctagtgg

SEQ ID NO: 3638 - DNA, 10 bp, Artificial Sequence
  synthetic Reed-Solomon code for 8+2 base, 1 base error, 2 nocall correction
tccgtagtat

SEQ ID NO: 3639 - DNA, 10 bp, Artificial Sequence
  synthetic Reed-Solomon code for 8+2 base, 1 base error, 2 nocall correction
cctgtagtac

SEQ ID NO: 3640 - DNA, 10 bp, Artificial Sequence
  synthetic Reed-Solomon code for 8+2 base, 1 base error, 2 nocall correction
cacttagtgt

SEQ ID NO: 3641 - DNA, 10 bp, Artificial Sequence
  synthetic Reed-Solomon code for 8+2 base, 1 base error, 2 nocall correction
cggttagtaa

SEQ ID NO: 3642 - DNA, 10 bp, Artificial Sequence
  synthetic Reed-Solomon code for 8+2 base, 1 base error, 2 nocall correction
atgttagtat

SEQ ID NO: 3643 - DNA, 10 bp, Artificial Sequence
  synthetic Reed-Solomon code for 8+2 base, 1 base error, 2 nocall correction
tatttagtgc

SEQ ID NO: 3644 - DNA, 10 bp, Artificial Sequence
  synthetic Reed-Solomon code for 8+2 base, 1 base error, 2 nocall correction
gttttagtca

SEQ ID NO: 3645 - DNA, 10 bp, Artificial Sequence
  synthetic Reed-Solomon code for 8+2 base, 1 base error, 2 nocall correction
ggcaacgtaa

SEQ ID NO: 3646 - DNA, 10 bp, Artificial Sequence
  synthetic Reed-Solomon code for 8+2 base, 1 base error, 2 nocall correction
gagaacgtgt

SEQ ID NO: 3647 - DNA, 10 bp, Artificial Sequence
  synthetic Reed-Solomon code for 8+2 base, 1 base error, 2 nocall correction
tataacgtgg

SEQ ID NO: 3648 - DNA, 10 bp, Artificial Sequence
  synthetic Reed-Solomon code for 8+2 base, 1 base error, 2 nocall correction
tgacacgtta

SEQ ID NO: 3649 - DNA, 10 bp, Artificial Sequence
  synthetic Reed-Solomon code for 8+2 base, 1 base error, 2 nocall correction
tcccacgtgt

SEQ ID NO: 3650 - DNA, 10 bp, Artificial Sequence
  synthetic Reed-Solomon code for 8+2 base, 1 base error, 2 nocall correction
cctcacgtgc

SEQ ID NO: 3651 - DNA, 10 bp, Artificial Sequence
  synthetic Reed-Solomon code for 8+2 base, 1 base error, 2 nocall correction
agtcacgttt

SEQ ID NO: 3652 - DNA, 10 bp, Artificial Sequence
  synthetic Reed-Solomon code for 8+2 base, 1 base error, 2 nocall correction
cttcacgtta

SEQ ID NO: 3653 - DNA, 10 bp, Artificial Sequence
  synthetic Reed-Solomon code for 8+2 base, 1 base error, 2 nocall correction
ggagacgtat

SEQ ID NO: 3654 - DNA, 10 bp, Artificial Sequence
  synthetic Reed-Solomon code for 8+2 base, 1 base error, 2 nocall correction
aacgacgtgg

SEQ ID NO: 3655 - DNA, 10 bp, Artificial Sequence
  synthetic Reed-Solomon code for 8+2 base, 1 base error, 2 nocall correction
gtcgacgtac

SEQ ID NO: 3656 - DNA, 10 bp, Artificial Sequence
  synthetic Reed-Solomon code for 8+2 base, 1 base error, 2 nocall correction
tgggacgtct

SEQ ID NO: 3657 - DNA, 10 bp, Artificial Sequence
  synthetic Reed-Solomon code for 8+2 base, 1 base error, 2 nocall correction
ctggacgtag

SEQ ID NO: 3658 - DNA, 10 bp, Artificial Sequence
  synthetic Reed-Solomon code for 8+2 base, 1 base error, 2 nocall correction
ggtgacgtcg

SEQ ID NO: 3659 - DNA, 10 bp, Artificial Sequence
  synthetic Reed-Solomon code for 8+2 base, 1 base error, 2 nocall correction
acatacgtcc

SEQ ID NO: 3660 - DNA, 10 bp, Artificial Sequence
  synthetic Reed-Solomon code for 8+2 base, 1 base error, 2 nocall correction
ccctacgtca

SEQ ID NO: 3661 - DNA, 10 bp, Artificial Sequence
  synthetic Reed-Solomon code for 8+2 base, 1 base error, 2 nocall correction
ttaaccgttt

SEQ ID NO: 3662 - DNA, 10 bp, Artificial Sequence
  synthetic Reed-Solomon code for 8+2 base, 1 base error, 2 nocall correction
tgcaccgttc

SEQ ID NO: 3663 - DNA, 10 bp, Artificial Sequence
  synthetic Reed-Solomon code for 8+2 base, 1 base error, 2 nocall correction
actaccgtgc

SEQ ID NO: 3664 - DNA, 10 bp, Artificial Sequence
  synthetic Reed-Solomon code for 8+2 base, 1 base error, 2 nocall correction
cgtaccgttt

SEQ ID NO: 3665 - DNA, 10 bp, Artificial Sequence
  synthetic Reed-Solomon code for 8+2 base, 1 base error, 2 nocall correction
attaccgtta

SEQ ID NO: 3666 - DNA, 10 bp, Artificial Sequence
  synthetic Reed-Solomon code for 8+2 base, 1 base error, 2 nocall correction
ggacccgtac

SEQ ID NO: 3667 - DNA, 10 bp, Artificial Sequence
  synthetic Reed-Solomon code for 8+2 base, 1 base error, 2 nocall correction
gtccccgtat

SEQ ID NO: 3668 - DNA, 10 bp, Artificial Sequence
  synthetic Reed-Solomon code for 8+2 base, 1 base error, 2 nocall correction
tggcccgtcc

SEQ ID NO: 3669 - DNA, 10 bp, Artificial Sequence
  synthetic Reed-Solomon code for 8+2 base, 1 base error, 2 nocall correction
tccgccgtgc

SEQ ID NO: 3670 - DNA, 10 bp, Artificial Sequence
  synthetic Reed-Solomon code for 8+2 base, 1 base error, 2 nocall correction
ttcgccgtta

SEQ ID NO: 3671 - DNA, 10 bp, Artificial Sequence
  synthetic Reed-Solomon code for 8+2 base, 1 base error, 2 nocall correction
cctgccgtgt

SEQ ID NO: 3672 - DNA, 10 bp, Artificial Sequence
  synthetic Reed-Solomon code for 8+2 base, 1 base error, 2 nocall correction
agtgccgttc

SEQ ID NO: 3673 - DNA, 10 bp, Artificial Sequence
  synthetic Reed-Solomon code for 8+2 base, 1 base error, 2 nocall correction
aaatccgtaa

SEQ ID NO: 3674 - DNA, 10 bp, Artificial Sequence
  synthetic Reed-Solomon code for 8+2 base, 1 base error, 2 nocall correction
taatccgtcg

SEQ ID NO: 3675 - DNA, 10 bp, Artificial Sequence
  synthetic Reed-Solomon code for 8+2 base, 1 base error, 2 nocall correction
gcatccgttg

SEQ ID NO: 3676 - DNA, 10 bp, Artificial Sequence
  synthetic Reed-Solomon code for 8+2 base, 1 base error, 2 nocall correction
cactccgtac

SEQ ID NO: 3677 - DNA, 10 bp, Artificial Sequence
  synthetic Reed-Solomon code for 8+2 base, 1 base error, 2 nocall correction
gagtccgtag

SEQ ID NO: 3678 - DNA, 10 bp, Artificial Sequence
  synthetic Reed-Solomon code for 8+2 base, 1 base error, 2 nocall correction
acgtccgtta

SEQ ID NO: 3679 - DNA, 10 bp, Artificial Sequence
  synthetic Reed-Solomon code for 8+2 base, 1 base error, 2 nocall correction
atgtccgtgc

SEQ ID NO: 3680 - DNA, 10 bp, Artificial Sequence
  synthetic Reed-Solomon code for 8+2 base, 1 base error, 2 nocall correction
tattccgtat

SEQ ID NO: 3681 - DNA, 10 bp, Artificial Sequence
  synthetic Reed-Solomon code for 8+2 base, 1 base error, 2 nocall correction
agaagcgtat

SEQ ID NO: 3682 - DNA, 10 bp, Artificial Sequence
  synthetic Reed-Solomon code for 8+2 base, 1 base error, 2 nocall correction
ctaagcgtaa

SEQ ID NO: 3683 - DNA, 10 bp, Artificial Sequence
  synthetic Reed-Solomon code for 8+2 base, 1 base error, 2 nocall correction
gacagcgtgg

SEQ ID NO: 3684 - DNA, 10 bp, Artificial Sequence
  synthetic Reed-Solomon code for 8+2 base, 1 base error, 2 nocall correction
atcagcgtac

SEQ ID NO: 3685 - DNA, 10 bp, Artificial Sequence
  synthetic Reed-Solomon code for 8+2 base, 1 base error, 2 nocall correction
cagagcgtgc

SEQ ID NO: 3686 - DNA, 10 bp, Artificial Sequence
  synthetic Reed-Solomon code for 8+2 base, 1 base error, 2 nocall correction
agtagcgtcg

SEQ ID NO: 3687 - DNA, 10 bp, Artificial Sequence
  synthetic Reed-Solomon code for 8+2 base, 1 base error, 2 nocall correction
tgtagcgtaa

SEQ ID NO: 3688 - DNA, 10 bp, Artificial Sequence
  synthetic Reed-Solomon code for 8+2 base, 1 base error, 2 nocall correction
tcgcgcgtgg

SEQ ID NO: 3689 - DNA, 10 bp, Artificial Sequence
  synthetic Reed-Solomon code for 8+2 base, 1 base error, 2 nocall correction
gctcgcgtgt

SEQ ID NO: 3690 - DNA, 10 bp, Artificial Sequence
  synthetic Reed-Solomon code for 8+2 base, 1 base error, 2 nocall correction
cgaggcgtac

SEQ ID NO: 3691 - DNA, 10 bp, Artificial Sequence
  synthetic Reed-Solomon code for 8+2 base, 1 base error, 2 nocall correction
agcggcgtaa

SEQ ID NO: 3692 - DNA, 10 bp, Artificial Sequence
  synthetic Reed-Solomon code for 8+2 base, 1 base error, 2 nocall correction
tgcggcgtcg

SEQ ID NO: 3693 - DNA, 10 bp, Artificial Sequence
  synthetic Reed-Solomon code for 8+2 base, 1 base error, 2 nocall correction
ctcggcgtat

SEQ ID NO: 3694 - DNA, 10 bp, Artificial Sequence
  synthetic Reed-Solomon code for 8+2 base, 1 base error, 2 nocall correction
aagggcgtgt

SEQ ID NO: 3695 - DNA, 10 bp, Artificial Sequence
  synthetic Reed-Solomon code for 8+2 base, 1 base error, 2 nocall correction
tttggcgtac

SEQ ID NO: 3696 - DNA, 10 bp, Artificial Sequence
  synthetic Reed-Solomon code for 8+2 base, 1 base error, 2 nocall correction
cattgcgtta

SEQ ID NO: 3697 - DNA, 10 bp, Artificial Sequence
  synthetic Reed-Solomon code for 8+2 base, 1 base error, 2 nocall correction
gaaatcgttc

SEQ ID NO: 3698 - DNA, 10 bp, Artificial Sequence
  synthetic Reed-Solomon code for 8+2 base, 1 base error, 2 nocall correction
tcaatcgtcc

SEQ ID NO: 3699 - DNA, 10 bp, Artificial Sequence
  synthetic Reed-Solomon code for 8+2 base, 1 base error, 2 nocall correction
cccatcgtag

SEQ ID NO: 3700 - DNA, 10 bp, Artificial Sequence
  synthetic Reed-Solomon code for 8+2 base, 1 base error, 2 nocall correction
gcgatcgtac

SEQ ID NO: 3701 - DNA, 10 bp, Artificial Sequence
  synthetic Reed-Solomon code for 8+2 base, 1 base error, 2 nocall correction
caactcgtcg

SEQ ID NO: 3702 - DNA, 10 bp, Artificial Sequence
  synthetic Reed-Solomon code for 8+2 base, 1 base error, 2 nocall correction
tacctcgtac

SEQ ID NO: 3703 - DNA, 10 bp, Artificial Sequence
  synthetic Reed-Solomon code for 8+2 base, 1 base error, 2 nocall correction
catctcgtat

SEQ ID NO: 3704 - DNA, 10 bp, Artificial Sequence
  synthetic Reed-Solomon code for 8+2 base, 1 base error, 2 nocall correction
cctgtcgtca

SEQ ID NO: 3705 - DNA, 10 bp, Artificial Sequence
  synthetic Reed-Solomon code for 8+2 base, 1 base error, 2 nocall correction
ggcttcgtcg

SEQ ID NO: 3706 - DNA, 10 bp, Artificial Sequence
  synthetic Reed-Solomon code for 8+2 base, 1 base error, 2 nocall correction
cggttcgtcc

SEQ ID NO: 3707 - DNA, 10 bp, Artificial Sequence
  synthetic Reed-Solomon code for 8+2 base, 1 base error, 2 nocall correction
aatttcgtgg

SEQ ID NO: 3708 - DNA, 10 bp, Artificial Sequence
  synthetic Reed-Solomon code for 8+2 base, 1 base error, 2 nocall correction
gttttcgtac

SEQ ID NO: 3709 - DNA, 10 bp, Artificial Sequence
  synthetic Reed-Solomon code for 8+2 base, 1 base error, 2 nocall correction
cacaaggtct

SEQ ID NO: 3710 - DNA, 10 bp, Artificial Sequence
  synthetic Reed-Solomon code for 8+2 base, 1 base error, 2 nocall correction
tataaggtcc

SEQ ID NO: 3711 - DNA, 10 bp, Artificial Sequence
  synthetic Reed-Solomon code for 8+2 base, 1 base error, 2 nocall correction
gctaaggttc

SEQ ID NO: 3712 - DNA, 10 bp, Artificial Sequence
  synthetic Reed-Solomon code for 8+2 base, 1 base error, 2 nocall correction
gttaaggtga

SEQ ID NO: 3713 - DNA, 10 bp, Artificial Sequence
  synthetic Reed-Solomon code for 8+2 base, 1 base error, 2 nocall correction
ccacaggtat

SEQ ID NO: 3714 - DNA, 10 bp, Artificial Sequence
  synthetic Reed-Solomon code for 8+2 base, 1 base error, 2 nocall correction
cagcaggttt

SEQ ID NO: 3715 - DNA, 10 bp, Artificial Sequence
  synthetic Reed-Solomon code for 8+2 base, 1 base error, 2 nocall correction
cctcaggtcg

SEQ ID NO: 3716 - DNA, 10 bp, Artificial Sequence
  synthetic Reed-Solomon code for 8+2 base, 1 base error, 2 nocall correction
caagaggtca

SEQ ID NO: 3717 - DNA, 10 bp, Artificial Sequence
  synthetic Reed-Solomon code for 8+2 base, 1 base error, 2 nocall correction
aacgaggtcc

SEQ ID NO: 3718 - DNA, 10 bp, Artificial Sequence
  synthetic Reed-Solomon code for 8+2 base, 1 base error, 2 nocall correction
ggtgaggtgc

SEQ ID NO: 3719 - DNA, 10 bp, Artificial Sequence
  synthetic Reed-Solomon code for 8+2 base, 1 base error, 2 nocall correction
acataggtgg

SEQ ID NO: 3720 - DNA, 10 bp, Artificial Sequence
  synthetic Reed-Solomon code for 8+2 base, 1 base error, 2 nocall correction
ctctaggttg

SEQ ID NO: 3721 - DNA, 10 bp, Artificial Sequence
  synthetic Reed-Solomon code for 8+2 base, 1 base error, 2 nocall correction
gcgtaggtga

SEQ ID NO: 3722 - DNA, 10 bp, Artificial Sequence
  synthetic Reed-Solomon code for 8+2 base, 1 base error, 2 nocall correction
gtgtaggttc

SEQ ID NO: 3723 - DNA, 10 bp, Artificial Sequence
  synthetic Reed-Solomon code for 8+2 base, 1 base error, 2 nocall correction
acaacggtat

SEQ ID NO: 3724 - DNA, 10 bp, Artificial Sequence
  synthetic Reed-Solomon code for 8+2 base, 1 base error, 2 nocall correction
aagacggttt

SEQ ID NO: 3725 - DNA, 10 bp, Artificial Sequence
  synthetic Reed-Solomon code for 8+2 base, 1 base error, 2 nocall correction
actacggtcg

SEQ ID NO: 3726 - DNA, 10 bp, Artificial Sequence
  synthetic Reed-Solomon code for 8+2 base, 1 base error, 2 nocall correction
tctacggtaa

SEQ ID NO: 3727 - DNA, 10 bp, Artificial Sequence
  synthetic Reed-Solomon code for 8+2 base, 1 base error, 2 nocall correction
aacccggtct

SEQ ID NO: 3728 - DNA, 10 bp, Artificial Sequence
  synthetic Reed-Solomon code for 8+2 base, 1 base error, 2 nocall correction
tggccggtgg

SEQ ID NO: 3729 - DNA, 10 bp, Artificial Sequence
  synthetic Reed-Solomon code for 8+2 base, 1 base error, 2 nocall correction
ggtccggtgt

SEQ ID NO: 3730 - DNA, 10 bp, Artificial Sequence
  synthetic Reed-Solomon code for 8+2 base, 1 base error, 2 nocall correction
ccagcggtac

SEQ ID NO: 3731 - DNA, 10 bp, Artificial Sequence
  synthetic Reed-Solomon code for 8+2 base, 1 base error, 2 nocall correction
gacgcggttg

SEQ ID NO: 3732 - DNA, 10 bp, Artificial Sequence
  synthetic Reed-Solomon code for 8+2 base, 1 base error, 2 nocall correction
accgcggtaa

SEQ ID NO: 3733 - DNA, 10 bp, Artificial Sequence
  synthetic Reed-Solomon code for 8+2 base, 1 base error, 2 nocall correction
tccgcggtcg

SEQ ID NO: 3734 - DNA, 10 bp, Artificial Sequence
  synthetic Reed-Solomon code for 8+2 base, 1 base error, 2 nocall correction
caggcggttc

SEQ ID NO: 3735 - DNA, 10 bp, Artificial Sequence
  synthetic Reed-Solomon code for 8+2 base, 1 base error, 2 nocall correction
taatcggtgc

SEQ ID NO: 3736 - DNA, 10 bp, Artificial Sequence
  synthetic Reed-Solomon code for 8+2 base, 1 base error, 2 nocall correction
gtatcggtca

SEQ ID NO: 3737 - DNA, 10 bp, Artificial Sequence
  synthetic Reed-Solomon code for 8+2 base, 1 base error, 2 nocall correction
atgtcggtcg

SEQ ID NO: 3738 - DNA, 10 bp, Artificial Sequence
  synthetic Reed-Solomon code for 8+2 base, 1 base error, 2 nocall correction
ttgtcggtaa

SEQ ID NO: 3739 - DNA, 10 bp, Artificial Sequence
  synthetic Reed-Solomon code for 8+2 base, 1 base error, 2 nocall correction
gacagggtcc

SEQ ID NO: 3740 - DNA, 10 bp, Artificial Sequence
  synthetic Reed-Solomon code for 8+2 base, 1 base error, 2 nocall correction
tccagggttc

SEQ ID NO: 3741 - DNA, 10 bp, Artificial Sequence
  synthetic Reed-Solomon code for 8+2 base, 1 base error, 2 nocall correction
ttcagggtga

SEQ ID NO: 3742 - DNA, 10 bp, Artificial Sequence
  synthetic Reed-Solomon code for 8+2 base, 1 base error, 2 nocall correction
cagagggtcg

SEQ ID NO: 3743 - DNA, 10 bp, Artificial Sequence
  synthetic Reed-Solomon code for 8+2 base, 1 base error, 2 nocall correction
cctagggttt

SEQ ID NO: 3744 - DNA, 10 bp, Artificial Sequence
  synthetic Reed-Solomon code for 8+2 base, 1 base error, 2 nocall correction
agtagggtgc

SEQ ID NO: 3745 - DNA, 10 bp, Artificial Sequence
  synthetic Reed-Solomon code for 8+2 base, 1 base error, 2 nocall correction
gcacgggtac

SEQ ID NO: 3746 - DNA, 10 bp, Artificial Sequence
  synthetic Reed-Solomon code for 8+2 base, 1 base error, 2 nocall correction
caccgggttg

SEQ ID NO: 3747 - DNA, 10 bp, Artificial Sequence
  synthetic Reed-Solomon code for 8+2 base, 1 base error, 2 nocall correction
gagcgggttc

SEQ ID NO: 3748 - DNA, 10 bp, Artificial Sequence
  synthetic Reed-Solomon code for 8+2 base, 1 base error, 2 nocall correction
tcgcgggtcc

SEQ ID NO: 3749 - DNA, 10 bp, Artificial Sequence
  synthetic Reed-Solomon code for 8+2 base, 1 base error, 2 nocall correction
ttaggggtgt

SEQ ID NO: 3750 - DNA, 10 bp, Artificial Sequence
  synthetic Reed-Solomon code for 8+2 base, 1 base error, 2 nocall correction
tgcggggtgc

SEQ ID NO: 3751 - DNA, 10 bp, Artificial Sequence
  synthetic Reed-Solomon code for 8+2 base, 1 base error, 2 nocall correction
actggggttc

SEQ ID NO: 3752 - DNA, 10 bp, Artificial Sequence
  synthetic Reed-Solomon code for 8+2 base, 1 base error, 2 nocall correction
cgtggggtgt

SEQ ID NO: 3753 - DNA, 10 bp, Artificial Sequence
  synthetic Reed-Solomon code for 8+2 base, 1 base error, 2 nocall correction
attggggtga

SEQ ID NO: 3754 - DNA, 10 bp, Artificial Sequence
  synthetic Reed-Solomon code for 8+2 base, 1 base error, 2 nocall correction
ggatgggttg

SEQ ID NO: 3755 - DNA, 10 bp, Artificial Sequence
  synthetic Reed-Solomon code for 8+2 base, 1 base error, 2 nocall correction
aggtgggtta

SEQ ID NO: 3756 - DNA, 10 bp, Artificial Sequence
  synthetic Reed-Solomon code for 8+2 base, 1 base error, 2 nocall correction
ctgtgggttt

SEQ ID NO: 3757 - DNA, 10 bp, Artificial Sequence
  synthetic Reed-Solomon code for 8+2 base, 1 base error, 2 nocall correction
tcaatggtgg

SEQ ID NO: 3758 - DNA, 10 bp, Artificial Sequence
  synthetic Reed-Solomon code for 8+2 base, 1 base error, 2 nocall correction
caactggtgc

SEQ ID NO: 3759 - DNA, 10 bp, Artificial Sequence
  synthetic Reed-Solomon code for 8+2 base, 1 base error, 2 nocall correction
aacctggtga

SEQ ID NO: 3760 - DNA, 10 bp, Artificial Sequence
  synthetic Reed-Solomon code for 8+2 base, 1 base error, 2 nocall correction
aggctggtat

SEQ ID NO: 3761 - DNA, 10 bp, Artificial Sequence
  synthetic Reed-Solomon code for 8+2 base, 1 base error, 2 nocall correction
ctgctggtaa

SEQ ID NO: 3762 - DNA, 10 bp, Artificial Sequence
  synthetic Reed-Solomon code for 8+2 base, 1 base error, 2 nocall correction
ggtctggtca

SEQ ID NO: 3763 - DNA, 10 bp, Artificial Sequence
  synthetic Reed-Solomon code for 8+2 base, 1 base error, 2 nocall correction
tgagtggttg

SEQ ID NO: 3764 - DNA, 10 bp, Artificial Sequence
  synthetic Reed-Solomon code for 8+2 base, 1 base error, 2 nocall correction
cttgtggttg

SEQ ID NO: 3765 - DNA, 10 bp, Artificial Sequence
  synthetic Reed-Solomon code for 8+2 base, 1 base error, 2 nocall correction
gtattggtgt

SEQ ID NO: 3766 - DNA, 10 bp, Artificial Sequence
  synthetic Reed-Solomon code for 8+2 base, 1 base error, 2 nocall correction
ggcttggtgc

SEQ ID NO: 3767 - DNA, 10 bp, Artificial Sequence
  synthetic Reed-Solomon code for 8+2 base, 1 base error, 2 nocall correction
cggttggtgg

SEQ ID NO: 3768 - DNA, 10 bp, Artificial Sequence
  synthetic Reed-Solomon code for 8+2 base, 1 base error, 2 nocall correction
aatttggtcc

SEQ ID NO: 3769 - DNA, 10 bp, Artificial Sequence
  synthetic Reed-Solomon code for 8+2 base, 1 base error, 2 nocall correction
tcgaatgtgc

SEQ ID NO: 3770 - DNA, 10 bp, Artificial Sequence
  synthetic Reed-Solomon code for 8+2 base, 1 base error, 2 nocall correction
ttgaatgtta

SEQ ID NO: 3771 - DNA, 10 bp, Artificial Sequence
  synthetic Reed-Solomon code for 8+2 base, 1 base error, 2 nocall correction
gaccatgtgc

SEQ ID NO: 3772 - DNA, 10 bp, Artificial Sequence
  synthetic Reed-Solomon code for 8+2 base, 1 base error, 2 nocall correction
atccatgtag

SEQ ID NO: 3773 - DNA, 10 bp, Artificial Sequence
  synthetic Reed-Solomon code for 8+2 base, 1 base error, 2 nocall correction
ttccatgtca

SEQ ID NO: 3774 - DNA, 10 bp, Artificial Sequence
  synthetic Reed-Solomon code for 8+2 base, 1 base error, 2 nocall correction
cagcatgtgg

SEQ ID NO: 3775 - DNA, 10 bp, Artificial Sequence
  synthetic Reed-Solomon code for 8+2 base, 1 base error, 2 nocall correction
agtcatgtcc

SEQ ID NO: 3776 - DNA, 10 bp, Artificial Sequence
  synthetic Reed-Solomon code for 8+2 base, 1 base error, 2 nocall correction
tgggatgttc

SEQ ID NO: 3777 - DNA, 10 bp, Artificial Sequence
  synthetic Reed-Solomon code for 8+2 base, 1 base error, 2 nocall correction
acatatgttt

SEQ ID NO: 3778 - DNA, 10 bp, Artificial Sequence
  synthetic Reed-Solomon code for 8+2 base, 1 base error, 2 nocall correction
cgatatgtgc

SEQ ID NO: 3779 - DNA, 10 bp, Artificial Sequence
  synthetic Reed-Solomon code for 8+2 base, 1 base error, 2 nocall correction
agctatgtga

SEQ ID NO: 3780 - DNA, 10 bp, Artificial Sequence
  synthetic Reed-Solomon code for 8+2 base, 1 base error, 2 nocall correction
ctctatgtgt

SEQ ID NO: 3781 - DNA, 10 bp, Artificial Sequence
  synthetic Reed-Solomon code for 8+2 base, 1 base error, 2 nocall correction
aagtatgtat

SEQ ID NO: 3782 - DNA, 10 bp, Artificial Sequence
  synthetic Reed-Solomon code for 8+2 base, 1 base error, 2 nocall correction
gattatgtca

SEQ ID NO: 3783 - DNA, 10 bp, Artificial Sequence
  synthetic Reed-Solomon code for 8+2 base, 1 base error, 2 nocall correction
tcttatgtta

SEQ ID NO: 3784 - DNA, 10 bp, Artificial Sequence
  synthetic Reed-Solomon code for 8+2 base, 1 base error, 2 nocall correction
ttttatgtgc

SEQ ID NO: 3785 - DNA, 10 bp, Artificial Sequence
  synthetic Reed-Solomon code for 8+2 base, 1 base error, 2 nocall correction
gaaactgtga

SEQ ID NO: 3786 - DNA, 10 bp, Artificial Sequence
  synthetic Reed-Solomon code for 8+2 base, 1 base error, 2 nocall correction
ttaactgtcc

SEQ ID NO: 3787 - DNA, 10 bp, Artificial Sequence
  synthetic Reed-Solomon code for 8+2 base, 1 base error, 2 nocall correction
tgcactgtct

SEQ ID NO: 3788 - DNA, 10 bp, Artificial Sequence
  synthetic Reed-Solomon code for 8+2 base, 1 base error, 2 nocall correction
ctcactgtag

SEQ ID NO: 3789 - DNA, 10 bp, Artificial Sequence
  synthetic Reed-Solomon code for 8+2 base, 1 base error, 2 nocall correction
aagactgtgg

SEQ ID NO: 3790 - DNA, 10 bp, Artificial Sequence
  synthetic Reed-Solomon code for 8+2 base, 1 base error, 2 nocall correction
gtgactgtac

SEQ ID NO: 3791 - DNA, 10 bp, Artificial Sequence
  synthetic Reed-Solomon code for 8+2 base, 1 base error, 2 nocall correction
cgtactgtcc

SEQ ID NO: 3792 - DNA, 10 bp, Artificial Sequence
  synthetic Reed-Solomon code for 8+2 base, 1 base error, 2 nocall correction
tggcctgttt

SEQ ID NO: 3793 - DNA, 10 bp, Artificial Sequence
  synthetic Reed-Solomon code for 8+2 base, 1 base error, 2 nocall correction
ggtcctgttg

SEQ ID NO: 3794 - DNA, 10 bp, Artificial Sequence
  synthetic Reed-Solomon code for 8+2 base, 1 base error, 2 nocall correction
agagctgtag

SEQ ID NO: 3795 - DNA, 10 bp, Artificial Sequence
  synthetic Reed-Solomon code for 8+2 base, 1 base error, 2 nocall correction
tgagctgtca

SEQ ID NO: 3796 - DNA, 10 bp, Artificial Sequence
  synthetic Reed-Solomon code for 8+2 base, 1 base error, 2 nocall correction
gacgctgtgt

SEQ ID NO: 3797 - DNA, 10 bp, Artificial Sequence
  synthetic Reed-Solomon code for 8+2 base, 1 base error, 2 nocall correction
ggggctgtaa

SEQ ID NO: 3798 - DNA, 10 bp, Artificial Sequence
  synthetic Reed-Solomon code for 8+2 base, 1 base error, 2 nocall correction
agtgctgtct

SEQ ID NO: 3799 - DNA, 10 bp, Artificial Sequence
  synthetic Reed-Solomon code for 8+2 base, 1 base error, 2 nocall correction
cttgctgtca

SEQ ID NO: 3800 - DNA, 10 bp, Artificial Sequence
  synthetic Reed-Solomon code for 8+2 base, 1 base error, 2 nocall correction
gcttctgtac

SEQ ID NO: 3801 - DNA, 10 bp, Artificial Sequence
  synthetic Reed-Solomon code for 8+2 base, 1 base error, 2 nocall correction
cctagtgtgg

SEQ ID NO: 3802 - DNA, 10 bp, Artificial Sequence
  synthetic Reed-Solomon code for 8+2 base, 1 base error, 2 nocall correction
caccgtgtgt

SEQ ID NO: 3803 - DNA, 10 bp, Artificial Sequence
  synthetic Reed-Solomon code for 8+2 base, 1 base error, 2 nocall correction
cggcgtgtaa

SEQ ID NO: 3804 - DNA, 10 bp, Artificial Sequence
  synthetic Reed-Solomon code for 8+2 base, 1 base error, 2 nocall correction
atgcgtgtat

SEQ ID NO: 3805 - DNA, 10 bp, Artificial Sequence
  synthetic Reed-Solomon code for 8+2 base, 1 base error, 2 nocall correction
tatcgtgtgc

SEQ ID NO: 3806 - DNA, 10 bp, Artificial Sequence
  synthetic Reed-Solomon code for 8+2 base, 1 base error, 2 nocall correction
gttcgtgtca

SEQ ID NO: 3807 - DNA, 10 bp, Artificial Sequence
  synthetic Reed-Solomon code for 8+2 base, 1 base error, 2 nocall correction
ttaggtgttg

SEQ ID NO: 3808 - DNA, 10 bp, Artificial Sequence
  synthetic Reed-Solomon code for 8+2 base, 1 base error, 2 nocall correction
cgtggtgttg

SEQ ID NO: 3809 - DNA, 10 bp, Artificial Sequence
  synthetic Reed-Solomon code for 8+2 base, 1 base error, 2 nocall correction
ggatgtgtgt

SEQ ID NO: 3810 - DNA, 10 bp, Artificial Sequence
  synthetic Reed-Solomon code for 8+2 base, 1 base error, 2 nocall correction
aactgtgtag

SEQ ID NO: 3811 - DNA, 10 bp, Artificial Sequence
  synthetic Reed-Solomon code for 8+2 base, 1 base error, 2 nocall correction
tactgtgtca

SEQ ID NO: 3812 - DNA, 10 bp, Artificial Sequence
  synthetic Reed-Solomon code for 8+2 base, 1 base error, 2 nocall correction
gcctgtgtta

SEQ ID NO: 3813 - DNA, 10 bp, Artificial Sequence
  synthetic Reed-Solomon code for 8+2 base, 1 base error, 2 nocall correction
gtctgtgtgc

SEQ ID NO: 3814 - DNA, 10 bp, Artificial Sequence
  synthetic Reed-Solomon code for 8+2 base, 1 base error, 2 nocall correction
ctgtgtgtgg

SEQ ID NO: 3815 - DNA, 10 bp, Artificial Sequence
  synthetic Reed-Solomon code for 8+2 base, 1 base error, 2 nocall correction
gaaattgtct

SEQ ID NO: 3816 - DNA, 10 bp, Artificial Sequence
  synthetic Reed-Solomon code for 8+2 base, 1 base error, 2 nocall correction
tcaattgttt

SEQ ID NO: 3817 - DNA, 10 bp, Artificial Sequence
  synthetic Reed-Solomon code for 8+2 base, 1 base error, 2 nocall correction
tgcattgtga

SEQ ID NO: 3818 - DNA, 10 bp, Artificial Sequence
  synthetic Reed-Solomon code for 8+2 base, 1 base error, 2 nocall correction
tagattgtat

SEQ ID NO: 3819 - DNA, 10 bp, Artificial Sequence
  synthetic Reed-Solomon code for 8+2 base, 1 base error, 2 nocall correction
gatattgtag

SEQ ID NO: 3820 - DNA, 10 bp, Artificial Sequence
  synthetic Reed-Solomon code for 8+2 base, 1 base error, 2 nocall correction
actattgtta

SEQ ID NO: 3821 - DNA, 10 bp, Artificial Sequence
  synthetic Reed-Solomon code for 8+2 base, 1 base error, 2 nocall correction
attattgtgc

SEQ ID NO: 3822 - DNA, 10 bp, Artificial Sequence
  synthetic Reed-Solomon code for 8+2 base, 1 base error, 2 nocall correction
gcccttgtat

SEQ ID NO: 3823 - DNA, 10 bp, Artificial Sequence
  synthetic Reed-Solomon code for 8+2 base, 1 base error, 2 nocall correction
tgagttgtgt

SEQ ID NO: 3824 - DNA, 10 bp, Artificial Sequence
  synthetic Reed-Solomon code for 8+2 base, 1 base error, 2 nocall correction
gacgttgtca

SEQ ID NO: 3825 - DNA, 10 bp, Artificial Sequence
  synthetic Reed-Solomon code for 8+2 base, 1 base error, 2 nocall correction
tccgttgtta

SEQ ID NO: 3826 - DNA, 10 bp, Artificial Sequence
  synthetic Reed-Solomon code for 8+2 base, 1 base error, 2 nocall correction
ttcgttgtgc

SEQ ID NO: 3827 - DNA, 10 bp, Artificial Sequence
  synthetic Reed-Solomon code for 8+2 base, 1 base error, 2 nocall correction
agtgttgtga

SEQ ID NO: 3828 - DNA, 10 bp, Artificial Sequence
  synthetic Reed-Solomon code for 8+2 base, 1 base error, 2 nocall correction
cttgttgtgt

SEQ ID NO: 3829 - DNA, 10 bp, Artificial Sequence
  synthetic Reed-Solomon code for 8+2 base, 1 base error, 2 nocall correction
gtatttgttg

SEQ ID NO: 3830 - DNA, 10 bp, Artificial Sequence
  synthetic Reed-Solomon code for 8+2 base, 1 base error, 2 nocall correction
acgtttgtgc

SEQ ID NO: 3831 - DNA, 10 bp, Artificial Sequence
  synthetic Reed-Solomon code for 8+2 base, 1 base error, 2 nocall correction
cggtttgttt

SEQ ID NO: 3832 - DNA, 10 bp, Artificial Sequence
  synthetic Reed-Solomon code for 8+2 base, 1 base error, 2 nocall correction
atgtttgtta

SEQ ID NO: 3833 - DNA, 10 bp, Artificial Sequence
  synthetic Reed-Solomon code for 8+2 base, 1 base error, 2 nocall correction
actaaattcc

SEQ ID NO: 3834 - DNA, 10 bp, Artificial Sequence
  synthetic Reed-Solomon code for 8+2 base, 1 base error, 2 nocall correction
tggcaattgc

SEQ ID NO: 3835 - DNA, 10 bp, Artificial Sequence
  synthetic Reed-Solomon code for 8+2 base, 1 base error, 2 nocall correction
catcaattaa

SEQ ID NO: 3836 - DNA, 10 bp, Artificial Sequence
  synthetic Reed-Solomon code for 8+2 base, 1 base error, 2 nocall correction
ccagaattag

SEQ ID NO: 3837 - DNA, 10 bp, Artificial Sequence
  synthetic Reed-Solomon code for 8+2 base, 1 base error, 2 nocall correction
gacgaatttc

SEQ ID NO: 3838 - DNA, 10 bp, Artificial Sequence
  synthetic Reed-Solomon code for 8+2 base, 1 base error, 2 nocall correction
tccgaattcc

SEQ ID NO: 3839 - DNA, 10 bp, Artificial Sequence
  synthetic Reed-Solomon code for 8+2 base, 1 base error, 2 nocall correction
caggaatttg

SEQ ID NO: 3840 - DNA, 10 bp, Artificial Sequence
  synthetic Reed-Solomon code for 8+2 base, 1 base error, 2 nocall correction
cctgaattct

SEQ ID NO: 3841 - DNA, 10 bp, Artificial Sequence
  synthetic Reed-Solomon code for 8+2 base, 1 base error, 2 nocall correction
taataattgg

SEQ ID NO: 3842 - DNA, 10 bp, Artificial Sequence
  synthetic Reed-Solomon code for 8+2 base, 1 base error, 2 nocall correction
atgtaattcc

SEQ ID NO: 3843 - DNA, 10 bp, Artificial Sequence
  synthetic Reed-Solomon code for 8+2 base, 1 base error, 2 nocall correction
taaacattat

SEQ ID NO: 3844 - DNA, 10 bp, Artificial Sequence
  synthetic Reed-Solomon code for 8+2 base, 1 base error, 2 nocall correction
gagacattct

SEQ ID NO: 3845 - DNA, 10 bp, Artificial Sequence
  synthetic Reed-Solomon code for 8+2 base, 1 base error, 2 nocall correction
tcgacatttt

SEQ ID NO: 3846 - DNA, 10 bp, Artificial Sequence
  synthetic Reed-Solomon code for 8+2 base, 1 base error, 2 nocall correction
aatacattaa

SEQ ID NO: 3847 - DNA, 10 bp, Artificial Sequence
  synthetic Reed-Solomon code for 8+2 base, 1 base error, 2 nocall correction
tatacattcg

SEQ ID NO: 3848 - DNA, 10 bp, Artificial Sequence
  synthetic Reed-Solomon code for 8+2 base, 1 base error, 2 nocall correction
gctacatttg

SEQ ID NO: 3849 - DNA, 10 bp, Artificial Sequence
  synthetic Reed-Solomon code for 8+2 base, 1 base error, 2 nocall correction
gacccatttt

SEQ ID NO: 3850 - DNA, 10 bp, Artificial Sequence
  synthetic Reed-Solomon code for 8+2 base, 1 base error, 2 nocall correction
tccccattct

SEQ ID NO: 3851 - DNA, 10 bp, Artificial Sequence
  synthetic Reed-Solomon code for 8+2 base, 1 base error, 2 nocall correction
cctccattcc

SEQ ID NO: 3852 - DNA, 10 bp, Artificial Sequence
  synthetic Reed-Solomon code for 8+2 base, 1 base error, 2 nocall correction
aacgcattcg

SEQ ID NO: 3853 - DNA, 10 bp, Artificial Sequence
  synthetic Reed-Solomon code for 8+2 base, 1 base error, 2 nocall correction
tacgcattaa

SEQ ID NO: 3854 - DNA, 10 bp, Artificial Sequence
  synthetic Reed-Solomon code for 8+2 base, 1 base error, 2 nocall correction
tgggcattgt

SEQ ID NO: 3855 - DNA, 10 bp, Artificial Sequence
  synthetic Reed-Solomon code for 8+2 base, 1 base error, 2 nocall correction
ggtgcattgg

SEQ ID NO: 3856 - DNA, 10 bp, Artificial Sequence
  synthetic Reed-Solomon code for 8+2 base, 1 base error, 2 nocall correction
acatcattgc

SEQ ID NO: 3857 - DNA, 10 bp, Artificial Sequence
  synthetic Reed-Solomon code for 8+2 base, 1 base error, 2 nocall correction
cgatcatttt

SEQ ID NO: 3858 - DNA, 10 bp, Artificial Sequence
  synthetic Reed-Solomon code for 8+2 base, 1 base error, 2 nocall correction
atatcattta

SEQ ID NO: 3859 - DNA, 10 bp, Artificial Sequence
  synthetic Reed-Solomon code for 8+2 base, 1 base error, 2 nocall correction
ccctcattga

SEQ ID NO: 3860 - DNA, 10 bp, Artificial Sequence
  synthetic Reed-Solomon code for 8+2 base, 1 base error, 2 nocall correction
ctctcatttc

SEQ ID NO: 3861 - DNA, 10 bp, Artificial Sequence
  synthetic Reed-Solomon code for 8+2 base, 1 base error, 2 nocall correction
gtgtcatttg

SEQ ID NO: 3862 - DNA, 10 bp, Artificial Sequence
  synthetic Reed-Solomon code for 8+2 base, 1 base error, 2 nocall correction
ttttcatttt

SEQ ID NO: 3863 - DNA, 10 bp, Artificial Sequence
  synthetic Reed-Solomon code for 8+2 base, 1 base error, 2 nocall correction
caaagattta

SEQ ID NO: 3864 - DNA, 10 bp, Artificial Sequence
  synthetic Reed-Solomon code for 8+2 base, 1 base error, 2 nocall correction
aacagatttc

SEQ ID NO: 3865 - DNA, 10 bp, Artificial Sequence
  synthetic Reed-Solomon code for 8+2 base, 1 base error, 2 nocall correction
ccgagattaa

SEQ ID NO: 3866 - DNA, 10 bp, Artificial Sequence
  synthetic Reed-Solomon code for 8+2 base, 1 base error, 2 nocall correction
ttacgattgg

SEQ ID NO: 3867 - DNA, 10 bp, Artificial Sequence
  synthetic Reed-Solomon code for 8+2 base, 1 base error, 2 nocall correction
aagcgattcc

SEQ ID NO: 3868 - DNA, 10 bp, Artificial Sequence
  synthetic Reed-Solomon code for 8+2 base, 1 base error, 2 nocall correction
cgtcgattgg

SEQ ID NO: 3869 - DNA, 10 bp, Artificial Sequence
  synthetic Reed-Solomon code for 8+2 base, 1 base error, 2 nocall correction
cacggatttt

SEQ ID NO: 3870 - DNA, 10 bp, Artificial Sequence
  synthetic Reed-Solomon code for 8+2 base, 1 base error, 2 nocall correction
tatggatttc

SEQ ID NO: 3871 - DNA, 10 bp, Artificial Sequence
  synthetic Reed-Solomon code for 8+2 base, 1 base error, 2 nocall correction
gctggattcc

SEQ ID NO: 3872 - DNA, 10 bp, Artificial Sequence
  synthetic Reed-Solomon code for 8+2 base, 1 base error, 2 nocall correction
agatgattcg

SEQ ID NO: 3873 - DNA, 10 bp, Artificial Sequence
  synthetic Reed-Solomon code for 8+2 base, 1 base error, 2 nocall correction
tgatgattaa

SEQ ID NO: 3874 - DNA, 10 bp, Artificial Sequence
  synthetic Reed-Solomon code for 8+2 base, 1 base error, 2 nocall correction
gggtgattca

SEQ ID NO: 3875 - DNA, 10 bp, Artificial Sequence
  synthetic Reed-Solomon code for 8+2 base, 1 base error, 2 nocall correction
agttgattat

SEQ ID NO: 3876 - DNA, 10 bp, Artificial Sequence
  synthetic Reed-Solomon code for 8+2 base, 1 base error, 2 nocall correction
ctttgattaa

SEQ ID NO: 3877 - DNA, 10 bp, Artificial Sequence
  synthetic Reed-Solomon code for 8+2 base, 1 base error, 2 nocall correction
aaaatattgg

SEQ ID NO: 3878 - DNA, 10 bp, Artificial Sequence
  synthetic Reed-Solomon code for 8+2 base, 1 base error, 2 nocall correction
gtaatattac

SEQ ID NO: 3879 - DNA, 10 bp, Artificial Sequence
  synthetic Reed-Solomon code for 8+2 base, 1 base error, 2 nocall correction
ggcatattat

SEQ ID NO: 3880 - DNA, 10 bp, Artificial Sequence
  synthetic Reed-Solomon code for 8+2 base, 1 base error, 2 nocall correction
gagatattga

SEQ ID NO: 3881 - DNA, 10 bp, Artificial Sequence
  synthetic Reed-Solomon code for 8+2 base, 1 base error, 2 nocall correction
ttgatattcc

SEQ ID NO: 3882 - DNA, 10 bp, Artificial Sequence
  synthetic Reed-Solomon code for 8+2 base, 1 base error, 2 nocall correction
tgactatttt

SEQ ID NO: 3883 - DNA, 10 bp, Artificial Sequence
  synthetic Reed-Solomon code for 8+2 base, 1 base error, 2 nocall correction
tccctattga

SEQ ID NO: 3884 - DNA, 10 bp, Artificial Sequence
  synthetic Reed-Solomon code for 8+2 base, 1 base error, 2 nocall correction
ttcctatttc

SEQ ID NO: 3885 - DNA, 10 bp, Artificial Sequence
  synthetic Reed-Solomon code for 8+2 base, 1 base error, 2 nocall correction
agtctattta

SEQ ID NO: 3886 - DNA, 10 bp, Artificial Sequence
  synthetic Reed-Solomon code for 8+2 base, 1 base error, 2 nocall correction
cttctatttt

SEQ ID NO: 3887 - DNA, 10 bp, Artificial Sequence
  synthetic Reed-Solomon code for 8+2 base, 1 base error, 2 nocall correction
ggagtattaa

SEQ ID NO: 3888 - DNA, 10 bp, Artificial Sequence
  synthetic Reed-Solomon code for 8+2 base, 1 base error, 2 nocall correction
agggtattag

SEQ ID NO: 3889 - DNA, 10 bp, Artificial Sequence
  synthetic Reed-Solomon code for 8+2 base, 1 base error, 2 nocall correction
tgggtattca

SEQ ID NO: 3890 - DNA, 10 bp, Artificial Sequence
  synthetic Reed-Solomon code for 8+2 base, 1 base error, 2 nocall correction
cccttattct

SEQ ID NO: 3891 - DNA, 10 bp, Artificial Sequence
  synthetic Reed-Solomon code for 8+2 base, 1 base error, 2 nocall correction
gatttatttc

SEQ ID NO: 3892 - DNA, 10 bp, Artificial Sequence
  synthetic Reed-Solomon code for 8+2 base, 1 base error, 2 nocall correction
tctttattcc

SEQ ID NO: 3893 - DNA, 10 bp, Artificial Sequence
  synthetic Reed-Solomon code for 8+2 base, 1 base error, 2 nocall correction
tcaaacttat

SEQ ID NO: 3894 - DNA, 10 bp, Artificial Sequence
  synthetic Reed-Solomon code for 8+2 base, 1 base error, 2 nocall correction
tagaactttt

SEQ ID NO: 3895 - DNA, 10 bp, Artificial Sequence
  synthetic Reed-Solomon code for 8+2 base, 1 base error, 2 nocall correction
gcgaacttct

SEQ ID NO: 3896 - DNA, 10 bp, Artificial Sequence
  synthetic Reed-Solomon code for 8+2 base, 1 base error, 2 nocall correction
gataactttg

SEQ ID NO: 3897 - DNA, 10 bp, Artificial Sequence
  synthetic Reed-Solomon code for 8+2 base, 1 base error, 2 nocall correction
actaacttaa

SEQ ID NO: 3898 - DNA, 10 bp, Artificial Sequence
  synthetic Reed-Solomon code for 8+2 base, 1 base error, 2 nocall correction
tctaacttcg

SEQ ID NO: 3899 - DNA, 10 bp, Artificial Sequence
  synthetic Reed-Solomon code for 8+2 base, 1 base error, 2 nocall correction
ggacacttga

SEQ ID NO: 3900 - DNA, 10 bp, Artificial Sequence
  synthetic Reed-Solomon code for 8+2 base, 1 base error, 2 nocall correction
taccacttct

SEQ ID NO: 3901 - DNA, 10 bp, Artificial Sequence
  synthetic Reed-Solomon code for 8+2 base, 1 base error, 2 nocall correction
gcccactttt

SEQ ID NO: 3902 - DNA, 10 bp, Artificial Sequence
  synthetic Reed-Solomon code for 8+2 base, 1 base error, 2 nocall correction
aggcacttgg

SEQ ID NO: 3903 - DNA, 10 bp, Artificial Sequence
  synthetic Reed-Solomon code for 8+2 base, 1 base error, 2 nocall correction
catcacttcc

SEQ ID NO: 3904 - DNA, 10 bp, Artificial Sequence
  synthetic Reed-Solomon code for 8+2 base, 1 base error, 2 nocall correction
accgacttcg

SEQ ID NO: 3905 - DNA, 10 bp, Artificial Sequence
  synthetic Reed-Solomon code for 8+2 base, 1 base error, 2 nocall correction
tccgacttaa

SEQ ID NO: 3906 - DNA, 10 bp, Artificial Sequence
  synthetic Reed-Solomon code for 8+2 base, 1 base error, 2 nocall correction
aaatacttgc

SEQ ID NO: 3907 - DNA, 10 bp, Artificial Sequence
  synthetic Reed-Solomon code for 8+2 base, 1 base error, 2 nocall correction
gtatacttag

SEQ ID NO: 3908 - DNA, 10 bp, Artificial Sequence
  synthetic Reed-Solomon code for 8+2 base, 1 base error, 2 nocall correction
cactacttga

SEQ ID NO: 3909 - DNA, 10 bp, Artificial Sequence
  synthetic Reed-Solomon code for 8+2 base, 1 base error, 2 nocall correction
cggtacttat

SEQ ID NO: 3910 - DNA, 10 bp, Artificial Sequence
  synthetic Reed-Solomon code for 8+2 base, 1 base error, 2 nocall correction
atgtacttaa

SEQ ID NO: 3911 - DNA, 10 bp, Artificial Sequence
  synthetic Reed-Solomon code for 8+2 base, 1 base error, 2 nocall correction
ttgtacttcg

SEQ ID NO: 3912 - DNA, 10 bp, Artificial Sequence
  synthetic Reed-Solomon code for 8+2 base, 1 base error, 2 nocall correction
gtttacttct

SEQ ID NO: 3913 - DNA, 10 bp, Artificial Sequence
  synthetic Reed-Solomon code for 8+2 base, 1 base error, 2 nocall correction
gtaaccttgt

SEQ ID NO: 3914 - DNA, 10 bp, Artificial Sequence
  synthetic Reed-Solomon code for 8+2 base, 1 base error, 2 nocall correction
ggcaccttgc

SEQ ID NO: 3915 - DNA, 10 bp, Artificial Sequence
  synthetic Reed-Solomon code for 8+2 base, 1 base error, 2 nocall correction
cggaccttgg

SEQ ID NO: 3916 - DNA, 10 bp, Artificial Sequence
  synthetic Reed-Solomon code for 8+2 base, 1 base error, 2 nocall correction
aataccttcc

SEQ ID NO: 3917 - DNA, 10 bp, Artificial Sequence
  synthetic Reed-Solomon code for 8+2 base, 1 base error, 2 nocall correction
cctcccttaa

SEQ ID NO: 3918 - DNA, 10 bp, Artificial Sequence
  synthetic Reed-Solomon code for 8+2 base, 1 base error, 2 nocall correction
caagccttag

SEQ ID NO: 3919 - DNA, 10 bp, Artificial Sequence
  synthetic Reed-Solomon code for 8+2 base, 1 base error, 2 nocall correction
tacgccttcc

SEQ ID NO: 3920 - DNA, 10 bp, Artificial Sequence
  synthetic Reed-Solomon code for 8+2 base, 1 base error, 2 nocall correction
gccgcctttc

SEQ ID NO: 3921 - DNA, 10 bp, Artificial Sequence
  synthetic Reed-Solomon code for 8+2 base, 1 base error, 2 nocall correction
gtcgccttga

SEQ ID NO: 3922 - DNA, 10 bp, Artificial Sequence
  synthetic Reed-Solomon code for 8+2 base, 1 base error, 2 nocall correction
ccggcctttg

SEQ ID NO: 3923 - DNA, 10 bp, Artificial Sequence
  synthetic Reed-Solomon code for 8+2 base, 1 base error, 2 nocall correction
catgccttct

SEQ ID NO: 3924 - DNA, 10 bp, Artificial Sequence
  synthetic Reed-Solomon code for 8+2 base, 1 base error, 2 nocall correction
tcatccttgg

SEQ ID NO: 3925 - DNA, 10 bp, Artificial Sequence
  synthetic Reed-Solomon code for 8+2 base, 1 base error, 2 nocall correction
tacagctttg

SEQ ID NO: 3926 - DNA, 10 bp, Artificial Sequence
  synthetic Reed-Solomon code for 8+2 base, 1 base error, 2 nocall correction
gccagcttcg

SEQ ID NO: 3927 - DNA, 10 bp, Artificial Sequence
  synthetic Reed-Solomon code for 8+2 base, 1 base error, 2 nocall correction
ccgagcttcc

SEQ ID NO: 3928 - DNA, 10 bp, Artificial Sequence
  synthetic Reed-Solomon code for 8+2 base, 1 base error, 2 nocall correction
gaacgcttag

SEQ ID NO: 3929 - DNA, 10 bp, Artificial Sequence
  synthetic Reed-Solomon code for 8+2 base, 1 base error, 2 nocall correction
acacgcttta

SEQ ID NO: 3930 - DNA, 10 bp, Artificial Sequence
  synthetic Reed-Solomon code for 8+2 base, 1 base error, 2 nocall correction
atacgcttgc

SEQ ID NO: 3931 - DNA, 10 bp, Artificial Sequence
  synthetic Reed-Solomon code for 8+2 base, 1 base error, 2 nocall correction
ccccgctttc

SEQ ID NO: 3932 - DNA, 10 bp, Artificial Sequence
  synthetic Reed-Solomon code for 8+2 base, 1 base error, 2 nocall correction
agccgcttgt

SEQ ID NO: 3933 - DNA, 10 bp, Artificial Sequence
  synthetic Reed-Solomon code for 8+2 base, 1 base error, 2 nocall correction
ctccgcttga

SEQ ID NO: 3934 - DNA, 10 bp, Artificial Sequence
  synthetic Reed-Solomon code for 8+2 base, 1 base error, 2 nocall correction
aagcgcttaa

SEQ ID NO: 3935 - DNA, 10 bp, Artificial Sequence
  synthetic Reed-Solomon code for 8+2 base, 1 base error, 2 nocall correction
tagcgcttcg

SEQ ID NO: 3936 - DNA, 10 bp, Artificial Sequence
  synthetic Reed-Solomon code for 8+2 base, 1 base error, 2 nocall correction
gcgcgctttg

SEQ ID NO: 3937 - DNA, 10 bp, Artificial Sequence
  synthetic Reed-Solomon code for 8+2 base, 1 base error, 2 nocall correction
gatcgcttct

SEQ ID NO: 3938 - DNA, 10 bp, Artificial Sequence
  synthetic Reed-Solomon code for 8+2 base, 1 base error, 2 nocall correction
tctcgctttt

SEQ ID NO: 3939 - DNA, 10 bp, Artificial Sequence
  synthetic Reed-Solomon code for 8+2 base, 1 base error, 2 nocall correction
acgggcttct

SEQ ID NO: 3940 - DNA, 10 bp, Artificial Sequence
  synthetic Reed-Solomon code for 8+2 base, 1 base error, 2 nocall correction
aatggctttg

SEQ ID NO: 3941 - DNA, 10 bp, Artificial Sequence
  synthetic Reed-Solomon code for 8+2 base, 1 base error, 2 nocall correction
gctggcttaa

SEQ ID NO: 3942 - DNA, 10 bp, Artificial Sequence
  synthetic Reed-Solomon code for 8+2 base, 1 base error, 2 nocall correction
tgatgcttcc

SEQ ID NO: 3943 - DNA, 10 bp, Artificial Sequence
  synthetic Reed-Solomon code for 8+2 base, 1 base error, 2 nocall correction
cgctgcttag

SEQ ID NO: 3944 - DNA, 10 bp, Artificial Sequence
  synthetic Reed-Solomon code for 8+2 base, 1 base error, 2 nocall correction
ttctgcttct

SEQ ID NO: 3945 - DNA, 10 bp, Artificial Sequence
  synthetic Reed-Solomon code for 8+2 base, 1 base error, 2 nocall correction
gggtgcttac

SEQ ID NO: 3946 - DNA, 10 bp, Artificial Sequence
  synthetic Reed-Solomon code for 8+2 base, 1 base error, 2 nocall correction
ctttgcttcc

SEQ ID NO: 3947 - DNA, 10 bp, Artificial Sequence
  synthetic Reed-Solomon code for 8+2 base, 1 base error, 2 nocall correction
taaatcttgc

SEQ ID NO: 3948 - DNA, 10 bp, Artificial Sequence
  synthetic Reed-Solomon code for 8+2 base, 1 base error, 2 nocall correction
gtaatcttca

SEQ ID NO: 3949 - DNA, 10 bp, Artificial Sequence
  synthetic Reed-Solomon code for 8+2 base, 1 base error, 2 nocall correction
atgatcttcg

SEQ ID NO: 3950 - DNA, 10 bp, Artificial Sequence
  synthetic Reed-Solomon code for 8+2 base, 1 base error, 2 nocall correction
ttgatcttaa

SEQ ID NO: 3951 - DNA, 10 bp, Artificial Sequence
  synthetic Reed-Solomon code for 8+2 base, 1 base error, 2 nocall correction
ccactcttgg

SEQ ID NO: 3952 - DNA, 10 bp, Artificial Sequence
  synthetic Reed-Solomon code for 8+2 base, 1 base error, 2 nocall correction
atcctctttg

SEQ ID NO: 3953 - DNA, 10 bp, Artificial Sequence
  synthetic Reed-Solomon code for 8+2 base, 1 base error, 2 nocall correction
ggagtcttcc

SEQ ID NO: 3954 - DNA, 10 bp, Artificial Sequence
  synthetic Reed-Solomon code for 8+2 base, 1 base error, 2 nocall correction
gtcgtcttct

SEQ ID NO: 3955 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
tgggtcttac

SEQ ID NO: 3956 - DNA, 10 bp, Artificial Sequence
  synthetic Reed-Solomon code for 8+2 base, 1 base error, 2 nocall correction
catgtcttga

SEQ ID NO: 3957 - DNA, 10 bp, Artificial Sequence
  synthetic Reed-Solomon code for 8+2 base, 1 base error, 2 nocall correction
acattcttat

SEQ ID NO: 3958 - DNA, 10 bp, Artificial Sequence
  synthetic Reed-Solomon code for 8+2 base, 1 base error, 2 nocall correction
aagttctttt

SEQ ID NO: 3959 - DNA, 10 bp, Artificial Sequence
  synthetic Reed-Solomon code for 8+2 base, 1 base error, 2 nocall correction
actttcttcg

SEQ ID NO: 3960 - DNA, 10 bp, Artificial Sequence
  synthetic Reed-Solomon code for 8+2 base, 1 base error, 2 nocall correction
tctttcttaa

SEQ ID NO: 3961 - DNA, 10 bp, Artificial Sequence
  synthetic Reed-Solomon code for 8+2 base, 1 base error, 2 nocall correction
cgaaagttta

SEQ ID NO: 3962 - DNA, 10 bp, Artificial Sequence
  synthetic Reed-Solomon code for 8+2 base, 1 base error, 2 nocall correction
ataaagtttt

SEQ ID NO: 3963 - DNA, 10 bp, Artificial Sequence
  synthetic Reed-Solomon code for 8+2 base, 1 base error, 2 nocall correction
cccaagttgt

SEQ ID NO: 3964 - DNA, 10 bp, Artificial Sequence
  synthetic Reed-Solomon code for 8+2 base, 1 base error, 2 nocall correction
agcaagtttc

SEQ ID NO: 3965 - DNA, 10 bp, Artificial Sequence
  synthetic Reed-Solomon code for 8+2 base, 1 base error, 2 nocall correction
tctaagttgc

SEQ ID NO: 3966 - DNA, 10 bp, Artificial Sequence
  synthetic Reed-Solomon code for 8+2 base, 1 base error, 2 nocall correction
tttaagttta

SEQ ID NO: 3967 - DNA, 10 bp, Artificial Sequence
  synthetic Reed-Solomon code for 8+2 base, 1 base error, 2 nocall correction
aggcagttcc

SEQ ID NO: 3968 - DNA, 10 bp, Artificial Sequence
  synthetic Reed-Solomon code for 8+2 base, 1 base error, 2 nocall correction
catcagttgg

SEQ ID NO: 3969 - DNA, 10 bp, Artificial Sequence
  synthetic Reed-Solomon code for 8+2 base, 1 base error, 2 nocall correction
ccagagttga

SEQ ID NO: 3970 - DNA, 10 bp, Artificial Sequence
  synthetic Reed-Solomon code for 8+2 base, 1 base error, 2 nocall correction
ctagagtttc

SEQ ID NO: 3971 - DNA, 10 bp, Artificial Sequence
  synthetic Reed-Solomon code for 8+2 base, 1 base error, 2 nocall correction
accgagttgc

SEQ ID NO: 3972 - DNA, 10 bp, Artificial Sequence
  synthetic Reed-Solomon code for 8+2 base, 1 base error, 2 nocall correction
cgcgagtttt

SEQ ID NO: 3973 - DNA, 10 bp, Artificial Sequence
  synthetic Reed-Solomon code for 8+2 base, 1 base error, 2 nocall correction
atcgagttta

SEQ ID NO: 3974 - DNA, 10 bp, Artificial Sequence
  synthetic Reed-Solomon code for 8+2 base, 1 base error, 2 nocall correction
tgtgagtttc

SEQ ID NO: 3975 - DNA, 10 bp, Artificial Sequence
  synthetic Reed-Solomon code for 8+2 base, 1 base error, 2 nocall correction
aaatagttcg

SEQ ID NO: 3976 - DNA, 10 bp, Artificial Sequence
  synthetic Reed-Solomon code for 8+2 base, 1 base error, 2 nocall correction
taatagttaa

SEQ ID NO: 3977 - DNA, 10 bp, Artificial Sequence
  synthetic Reed-Solomon code for 8+2 base, 1 base error, 2 nocall correction
gagtagttca

SEQ ID NO: 3978 - DNA, 10 bp, Artificial Sequence
  synthetic Reed-Solomon code for 8+2 base, 1 base error, 2 nocall correction
tcgtagttta

SEQ ID NO: 3979 - DNA, 10 bp, Artificial Sequence
  synthetic Reed-Solomon code for 8+2 base, 1 base error, 2 nocall correction
ttgtagttgc

SEQ ID NO: 3980 - DNA, 10 bp, Artificial Sequence
  synthetic Reed-Solomon code for 8+2 base, 1 base error, 2 nocall correction
aattagttat

SEQ ID NO: 3981 - DNA, 10 bp, Artificial Sequence
  synthetic Reed-Solomon code for 8+2 base, 1 base error, 2 nocall correction
ggcacgttcg

SEQ ID NO: 3982 - DNA, 10 bp, Artificial Sequence
  synthetic Reed-Solomon code for 8+2 base, 1 base error, 2 nocall correction
cggacgttcc

SEQ ID NO: 3983 - DNA, 10 bp, Artificial Sequence
  synthetic Reed-Solomon code for 8+2 base, 1 base error, 2 nocall correction
aatacgttgg

SEQ ID NO: 3984 - DNA, 10 bp, Artificial Sequence
  synthetic Reed-Solomon code for 8+2 base, 1 base error, 2 nocall correction
gttacgttac

SEQ ID NO: 3985 - DNA, 10 bp, Artificial Sequence
  synthetic Reed-Solomon code for 8+2 base, 1 base error, 2 nocall correction
agaccgttta

SEQ ID NO: 3986 - DNA, 10 bp, Artificial Sequence
  synthetic Reed-Solomon code for 8+2 base, 1 base error, 2 nocall correction
ctaccgtttt

SEQ ID NO: 3987 - DNA, 10 bp, Artificial Sequence
  synthetic Reed-Solomon code for 8+2 base, 1 base error, 2 nocall correction
accccgttgt

SEQ ID NO: 3988 - DNA, 10 bp, Artificial Sequence
  synthetic Reed-Solomon code for 8+2 base, 1 base error, 2 nocall correction
cgcccgtttc

SEQ ID NO: 3989 - DNA, 10 bp, Artificial Sequence
  synthetic Reed-Solomon code for 8+2 base, 1 base error, 2 nocall correction
gggccgtttg

SEQ ID NO: 3990 - DNA, 10 bp, Artificial Sequence
  synthetic Reed-Solomon code for 8+2 base, 1 base error, 2 nocall correction
tgtccgtttt

SEQ ID NO: 3991 - DNA, 10 bp, Artificial Sequence
  synthetic Reed-Solomon code for 8+2 base, 1 base error, 2 nocall correction
tacgcgttgg

SEQ ID NO: 3992 - DNA, 10 bp, Artificial Sequence
  synthetic Reed-Solomon code for 8+2 base, 1 base error, 2 nocall correction
agggcgttct

SEQ ID NO: 3993 - DNA, 10 bp, Artificial Sequence
  synthetic Reed-Solomon code for 8+2 base, 1 base error, 2 nocall correction
ctggcgttca

SEQ ID NO: 3994 - DNA, 10 bp, Artificial Sequence
  synthetic Reed-Solomon code for 8+2 base, 1 base error, 2 nocall correction
ggtgcgttaa

SEQ ID NO: 3995 - DNA, 10 bp, Artificial Sequence
  synthetic Reed-Solomon code for 8+2 base, 1 base error, 2 nocall correction
gaatcgtttc

SEQ ID NO: 3996 - DNA, 10 bp, Artificial Sequence
  synthetic Reed-Solomon code for 8+2 base, 1 base error, 2 nocall correction
tcatcgttcc

SEQ ID NO: 3997 - DNA, 10 bp, Artificial Sequence
  synthetic Reed-Solomon code for 8+2 base, 1 base error, 2 nocall correction
ccctcgttag

SEQ ID NO: 3998 - DNA, 10 bp, Artificial Sequence
  synthetic Reed-Solomon code for 8+2 base, 1 base error, 2 nocall correction
gcgtcgttac

SEQ ID NO: 3999 - DNA, 10 bp, Artificial Sequence
  synthetic Reed-Solomon code for 8+2 base, 1 base error, 2 nocall correction
gccaggttgc

SEQ ID NO: 4000 - DNA, 10 bp, Artificial Sequence
  synthetic Reed-Solomon code for 8+2 base, 1 base error, 2 nocall correction
gtcaggttta

SEQ ID NO: 4001 - DNA, 10 bp, Artificial Sequence
  synthetic Reed-Solomon code for 8+2 base, 1 base error, 2 nocall correction
ccgaggttgg

SEQ ID NO: 4002 - DNA, 10 bp, Artificial Sequence
  synthetic Reed-Solomon code for 8+2 base, 1 base error, 2 nocall correction
atacggttcg

SEQ ID NO: 4003 - DNA, 10 bp, Artificial Sequence
  synthetic Reed-Solomon code for 8+2 base, 1 base error, 2 nocall correction
ttacggttaa

SEQ ID NO: 4004 - DNA, 10 bp, Artificial Sequence
  synthetic Reed-Solomon code for 8+2 base, 1 base error, 2 nocall correction
tagcggttgc

SEQ ID NO: 4005 - DNA, 10 bp, Artificial Sequence
  synthetic Reed-Solomon code for 8+2 base, 1 base error, 2 nocall correction
gtgcggttca

SEQ ID NO: 4006 - DNA, 10 bp, Artificial Sequence
  synthetic Reed-Solomon code for 8+2 base, 1 base error, 2 nocall correction
cgtcggttaa

SEQ ID NO: 4007 - DNA, 10 bp, Artificial Sequence
  synthetic Reed-Solomon code for 8+2 base, 1 base error, 2 nocall correction
attcggttat

SEQ ID NO: 4008 - DNA, 10 bp, Artificial Sequence
  synthetic Reed-Solomon code for 8+2 base, 1 base error, 2 nocall correction
gtagggtttt

SEQ ID NO: 4009 - DNA, 10 bp, Artificial Sequence
  synthetic Reed-Solomon code for 8+2 base, 1 base error, 2 nocall correction
ggcgggtttc

SEQ ID NO: 4010 - DNA, 10 bp, Artificial Sequence
  synthetic Reed-Solomon code for 8+2 base, 1 base error, 2 nocall correction
cgggggtttg

SEQ ID NO: 4011 - DNA, 10 bp, Artificial Sequence
  synthetic Reed-Solomon code for 8+2 base, 1 base error, 2 nocall correction
tgatggttgg

SEQ ID NO: 4012 - DNA, 10 bp, Artificial Sequence
  synthetic Reed-Solomon code for 8+2 base, 1 base error, 2 nocall correction
ctttggttgg

SEQ ID NO: 4013 - DNA, 10 bp, Artificial Sequence
  synthetic Reed-Solomon code for 8+2 base, 1 base error, 2 nocall correction
aaaatgttaa

SEQ ID NO: 4014 - DNA, 10 bp, Artificial Sequence
  synthetic Reed-Solomon code for 8+2 base, 1 base error, 2 nocall correction
taaatgttcg

SEQ ID NO: 4015 - DNA, 10 bp, Artificial Sequence
  synthetic Reed-Solomon code for 8+2 base, 1 base error, 2 nocall correction
gcaatgtttg

SEQ ID NO: 4016 - DNA, 10 bp, Artificial Sequence
  synthetic Reed-Solomon code for 8+2 base, 1 base error, 2 nocall correction
cacatgttac

SEQ ID NO: 4017 - DNA, 10 bp, Artificial Sequence
  synthetic Reed-Solomon code for 8+2 base, 1 base error, 2 nocall correction
gagatgttag

SEQ ID NO: 4018 - DNA, 10 bp, Artificial Sequence
  synthetic Reed-Solomon code for 8+2 base, 1 base error, 2 nocall correction
acgatgttta

SEQ ID NO: 4019 - DNA, 10 bp, Artificial Sequence
  synthetic Reed-Solomon code for 8+2 base, 1 base error, 2 nocall correction
atgatgttgc

SEQ ID NO: 4020 - DNA, 10 bp, Artificial Sequence
  synthetic Reed-Solomon code for 8+2 base, 1 base error, 2 nocall correction
tatatgttat

SEQ ID NO: 4021 - DNA, 10 bp, Artificial Sequence
  synthetic Reed-Solomon code for 8+2 base, 1 base error, 2 nocall correction
ccactgttcc

SEQ ID NO: 4022 - DNA, 10 bp, Artificial Sequence
  synthetic Reed-Solomon code for 8+2 base, 1 base error, 2 nocall correction
accctgttca

SEQ ID NO: 4023 - DNA, 10 bp, Artificial Sequence
  synthetic Reed-Solomon code for 8+2 base, 1 base error, 2 nocall correction, Reed-Solomon code for 6+4 base, 2 base error, 4 nocall correction
tccctgttag

SEQ ID NO: 4024 - DNA, 10 bp, Artificial Sequence
  synthetic Reed-Solomon code for 8+2 base, 1 base error, 2 nocall correction
ggagtgttgg

SEQ ID NO: 4025 - DNA, 10 bp, Artificial Sequence
  synthetic Reed-Solomon code for 8+2 base, 1 base error, 2 nocall correction
aacgtgttat

SEQ ID NO: 4026 - DNA, 10 bp, Artificial Sequence
  synthetic Reed-Solomon code for 8+2 base, 1 base error, 2 nocall correction
agggtgttga

SEQ ID NO: 4027 - DNA, 10 bp, Artificial Sequence
  synthetic Reed-Solomon code for 8+2 base, 1 base error, 2 nocall correction
ctggtgttgt

SEQ ID NO: 4028 - DNA, 10 bp, Artificial Sequence
  synthetic Reed-Solomon code for 8+2 base, 1 base error, 2 nocall correction
ttattgtttt

SEQ ID NO: 4029 - DNA, 10 bp, Artificial Sequence
  synthetic Reed-Solomon code for 8+2 base, 1 base error, 2 nocall correction
tgcttgtttc

SEQ ID NO: 4030 - DNA, 10 bp, Artificial Sequence
  synthetic Reed-Solomon code for 8+2 base, 1 base error, 2 nocall correction
actttgttgc

SEQ ID NO: 4031 - DNA, 10 bp, Artificial Sequence
  synthetic Reed-Solomon code for 8+2 base, 1 base error, 2 nocall correction
cgtttgtttt

SEQ ID NO: 4032 - DNA, 10 bp, Artificial Sequence
  synthetic Reed-Solomon code for 8+2 base, 1 base error, 2 nocall correction
attttgttta

SEQ ID NO: 4033 - DNA, 10 bp, Artificial Sequence
  synthetic Reed-Solomon code for 8+2 base, 1 base error, 2 nocall correction
gaaaatttac

SEQ ID NO: 4034 - DNA, 10 bp, Artificial Sequence
  synthetic Reed-Solomon code for 8+2 base, 1 base error, 2 nocall correction
ataaatttgg

SEQ ID NO: 4035 - DNA, 10 bp, Artificial Sequence
  synthetic Reed-Solomon code for 8+2 base, 1 base error, 2 nocall correction
cccaattttg

SEQ ID NO: 4036 - DNA, 10 bp, Artificial Sequence
  synthetic Reed-Solomon code for 8+2 base, 1 base error, 2 nocall correction
tagaatttcc

SEQ ID NO: 4037 - DNA, 10 bp, Artificial Sequence
  synthetic Reed-Solomon code for 8+2 base, 1 base error, 2 nocall correction
gcgaattttc

SEQ ID NO: 4038 - DNA, 10 bp, Artificial Sequence
  synthetic Reed-Solomon code for 8+2 base, 1 base error, 2 nocall correction
gtgaatttga

SEQ ID NO: 4039 - DNA, 10 bp, Artificial Sequence
  synthetic Reed-Solomon code for 8+2 base, 1 base error, 2 nocall correction
taccattttc

SEQ ID NO: 4040 - DNA, 10 bp, Artificial Sequence
  synthetic Reed-Solomon code for 8+2 base, 1 base error, 2 nocall correction
gcccatttcc

SEQ ID NO: 4041 - DNA, 10 bp, Artificial Sequence
  synthetic Reed-Solomon code for 8+2 base, 1 base error, 2 nocall correction
ccgcatttcg

SEQ ID NO: 4042 - DNA, 10 bp, Artificial Sequence
  synthetic Reed-Solomon code for 8+2 base, 1 base error, 2 nocall correction
catcattttt

SEQ ID NO: 4043 - DNA, 10 bp, Artificial Sequence
  synthetic Reed-Solomon code for 8+2 base, 1 base error, 2 nocall correction
cgcgatttgg

SEQ ID NO: 4044 - DNA, 10 bp, Artificial Sequence
  synthetic Reed-Solomon code for 8+2 base, 1 base error, 2 nocall correction
ggggatttgc

SEQ ID NO: 4045 - DNA, 10 bp, Artificial Sequence
  synthetic Reed-Solomon code for 8+2 base, 1 base error, 2 nocall correction
gcttatttga

SEQ ID NO: 4046 - DNA, 10 bp, Artificial Sequence
  synthetic Reed-Solomon code for 8+2 base, 1 base error, 2 nocall correction
gtttattttc

SEQ ID NO: 4047 - DNA, 10 bp, Artificial Sequence
  synthetic Reed-Solomon code for 8+2 base, 1 base error, 2 nocall correction
taaactttta

SEQ ID NO: 4048 - DNA, 10 bp, Artificial Sequence
  synthetic Reed-Solomon code for 8+2 base, 1 base error, 2 nocall correction
gcaactttca

SEQ ID NO: 4049 - DNA, 10 bp, Artificial Sequence
  synthetic Reed-Solomon code for 8+2 base, 1 base error, 2 nocall correction
acgactttcg

SEQ ID NO: 4050 - DNA, 10 bp, Artificial Sequence
  synthetic Reed-Solomon code for 8+2 base, 1 base error, 2 nocall correction
tcgactttaa

SEQ ID NO: 4051 - DNA, 10 bp, Artificial Sequence
  synthetic Reed-Solomon code for 8+2 base, 1 base error, 2 nocall correction
aatacttttt

SEQ ID NO: 4052 - DNA, 10 bp, Artificial Sequence
  synthetic Reed-Solomon code for 8+2 base, 1 base error, 2 nocall correction
ctacctttgg

SEQ ID NO: 4053 - DNA, 10 bp, Artificial Sequence
  synthetic Reed-Solomon code for 8+2 base, 1 base error, 2 nocall correction
gaccctttaa

SEQ ID NO: 4054 - DNA, 10 bp, Artificial Sequence
  synthetic Reed-Solomon code for 8+2 base, 1 base error, 2 nocall correction
accccttttg

SEQ ID NO: 4055 - DNA, 10 bp, Artificial Sequence
  synthetic Reed-Solomon code for 8+2 base, 1 base error, 2 nocall correction
gggcctttgt

SEQ ID NO: 4056 - DNA, 10 bp, Artificial Sequence
  synthetic Reed-Solomon code for 8+2 base, 1 base error, 2 nocall correction
tgtcctttgg

SEQ ID NO: 4057 - DNA, 10 bp, Artificial Sequence
  synthetic Reed-Solomon code for 8+2 base, 1 base error, 2 nocall correction
tacgcttttt

SEQ ID NO: 4058 - DNA, 10 bp, Artificial Sequence
  synthetic Reed-Solomon code for 8+2 base, 1 base error, 2 nocall correction
gccgctttct

SEQ ID NO: 4059 - DNA, 10 bp, Artificial Sequence
  synthetic Reed-Solomon code for 8+2 base, 1 base error, 2 nocall correction
catgcttttc

SEQ ID NO: 4060 - DNA, 10 bp, Artificial Sequence
  synthetic Reed-Solomon code for 8+2 base, 1 base error, 2 nocall correction
cgatctttaa

SEQ ID NO: 4061 - DNA, 10 bp, Artificial Sequence
  synthetic Reed-Solomon code for 8+2 base, 1 base error, 2 nocall correction
atatctttat

SEQ ID NO: 4062 - DNA, 10 bp, Artificial Sequence
  synthetic Reed-Solomon code for 8+2 base, 1 base error, 2 nocall correction
agctctttac

SEQ ID NO: 4063 - DNA, 10 bp, Artificial Sequence
  synthetic Reed-Solomon code for 8+2 base, 1 base error, 2 nocall correction
atttctttcg

SEQ ID NO: 4064 - DNA, 10 bp, Artificial Sequence
  synthetic Reed-Solomon code for 8+2 base, 1 base error, 2 nocall correction
ttttctttaa

SEQ ID NO: 4065 - DNA, 10 bp, Artificial Sequence
  synthetic Reed-Solomon code for 8+2 base, 1 base error, 2 nocall correction
caaagtttat

SEQ ID NO: 4066 - DNA, 10 bp, Artificial Sequence
  synthetic Reed-Solomon code for 8+2 base, 1 base error, 2 nocall correction
ccgagttttt

SEQ ID NO: 4067 - DNA, 10 bp, Artificial Sequence
  synthetic Reed-Solomon code for 8+2 base, 1 base error, 2 nocall correction
aggagtttgc

SEQ ID NO: 4068 - DNA, 10 bp, Artificial Sequence
  synthetic Reed-Solomon code for 8+2 base, 1 base error, 2 nocall correction
catagtttcg

SEQ ID NO: 4069 - DNA, 10 bp, Artificial Sequence
  synthetic Reed-Solomon code for 8+2 base, 1 base error, 2 nocall correction
ccccgtttct

SEQ ID NO: 4070 - DNA, 10 bp, Artificial Sequence
  synthetic Reed-Solomon code for 8+2 base, 1 base error, 2 nocall correction
gatcgttttc

SEQ ID NO: 4071 - DNA, 10 bp, Artificial Sequence
  synthetic Reed-Solomon code for 8+2 base, 1 base error, 2 nocall correction
tctcgtttcc

SEQ ID NO: 4072 - DNA, 10 bp, Artificial Sequence
  synthetic Reed-Solomon code for 8+2 base, 1 base error, 2 nocall correction
aaaggtttac

SEQ ID NO: 4073 - DNA, 10 bp, Artificial Sequence
  synthetic Reed-Solomon code for 8+2 base, 1 base error, 2 nocall correction
gtaggtttgg

SEQ ID NO: 4074 - DNA, 10 bp, Artificial Sequence
  synthetic Reed-Solomon code for 8+2 base, 1 base error, 2 nocall correction
cacggtttaa

SEQ ID NO: 4075 - DNA, 10 bp, Artificial Sequence
  synthetic Reed-Solomon code for 8+2 base, 1 base error, 2 nocall correction
acgggttttc

SEQ ID NO: 4076 - DNA, 10 bp, Artificial Sequence
  synthetic Reed-Solomon code for 8+2 base, 1 base error, 2 nocall correction
cggggtttgt

SEQ ID NO: 4077 - DNA, 10 bp, Artificial Sequence
  synthetic Reed-Solomon code for 8+2 base, 1 base error, 2 nocall correction
atgggtttga

SEQ ID NO: 4078 - DNA, 10 bp, Artificial Sequence
  synthetic Reed-Solomon code for 8+2 base, 1 base error, 2 nocall correction
tgatgttttt

SEQ ID NO: 4079 - DNA, 10 bp, Artificial Sequence
  synthetic Reed-Solomon code for 8+2 base, 1 base error, 2 nocall correction
tcctgtttga

SEQ ID NO: 4080 - DNA, 10 bp, Artificial Sequence
  synthetic Reed-Solomon code for 8+2 base, 1 base error, 2 nocall correction
ttctgttttc

SEQ ID NO: 4081 - DNA, 10 bp, Artificial Sequence
  synthetic Reed-Solomon code for 8+2 base, 1 base error, 2 nocall correction
agttgtttta

SEQ ID NO: 4082 - DNA, 10 bp, Artificial Sequence
  synthetic Reed-Solomon code for 8+2 base, 1 base error, 2 nocall correction
ctttgttttt

SEQ ID NO: 4083 - DNA, 10 bp, Artificial Sequence
  synthetic Reed-Solomon code for 8+2 base, 1 base error, 2 nocall correction
gcaattttgt

SEQ ID NO: 4084 - DNA, 10 bp, Artificial Sequence
  synthetic Reed-Solomon code for 8+2 base, 1 base error, 2 nocall correction
ggcattttta

SEQ ID NO: 4085 - DNA, 10 bp, Artificial Sequence
  synthetic Reed-Solomon code for 8+2 base, 1 base error, 2 nocall correction
agacttttcg

SEQ ID NO: 4086 - DNA, 10 bp, Artificial Sequence
  synthetic Reed-Solomon code for 8+2 base, 1 base error, 2 nocall correction
tgacttttaa

SEQ ID NO: 4087 - DNA, 10 bp, Artificial Sequence
  synthetic Reed-Solomon code for 8+2 base, 1 base error, 2 nocall correction
gggcttttca

SEQ ID NO: 4088 - DNA, 10 bp, Artificial Sequence
  synthetic Reed-Solomon code for 8+2 base, 1 base error, 2 nocall correction
agtcttttat

SEQ ID NO: 4089 - DNA, 10 bp, Artificial Sequence
  synthetic Reed-Solomon code for 8+2 base, 1 base error, 2 nocall correction
cttcttttaa

SEQ ID NO: 4090 - DNA, 10 bp, Artificial Sequence
  synthetic Reed-Solomon code for 8+2 base, 1 base error, 2 nocall correction
ggagtttttt

SEQ ID NO: 4091 - DNA, 10 bp, Artificial Sequence
  synthetic Reed-Solomon code for 8+2 base, 1 base error, 2 nocall correction
gccgttttga

SEQ ID NO: 4092 - DNA, 10 bp, Artificial Sequence
  synthetic Reed-Solomon code for 8+2 base, 1 base error, 2 nocall correction
gtcgtttttc

SEQ ID NO: 4093 - DNA, 10 bp, Artificial Sequence
  synthetic Reed-Solomon code for 8+2 base, 1 base error, 2 nocall correction
ctggtttttg

SEQ ID NO: 4094 - DNA, 10 bp, Artificial Sequence
  synthetic Reed-Solomon code for 8+2 base, 1 base error, 2 nocall correction
ttatttttgg

SEQ ID NO: 4095 - DNA, 10 bp, Artificial Sequence
  synthetic Reed-Solomon code for 8+2 base, 1 base error, 2 nocall correction
aagtttttcc

SEQ ID NO: 4096 - DNA, 10 bp, Artificial Sequence
  synthetic Reed-Solomon code for 8+2 base, 1 base error, 2 nocall correction
cgttttttgg

SEQ ID NO: 4097 - DNA, 10 bp, Artificial Sequence
  synthetic preliminary base call sequence from a set of overlapping sequences
ctagcatcgt

SEQ ID NO: 4098 - DNA, 10 bp, Artificial Sequence
  synthetic corrected base call sequence
gtagcatcgc

SEQ ID NO: 4099 - DNA, 10 bp, Artificial Sequence
  synthetic observed sequence
cggttcttat

SEQ ID NO: 4100 - DNA, 10 bp, Artificial Sequence
  synthetic observed sequence
agactggcgc

SEQ ID NO: 4101 - DNA, 10 bp, Artificial Sequence
  synthetic observed sequence
aggacaccgc

SEQ ID NO: 4102 - DNA, 10 bp, Artificial Sequence
  synthetic observed sequence
actttattac

SEQ ID NO: 4103 - DNA, 10 bp, Artificial Sequence
  synthetic observed sequence
ttgcgggctt

SEQ ID NO: 4104 - DNA, 10 bp, Artificial Sequence
  synthetic observed sequence
tactcagtca

SEQ ID NO: 4105 - DNA, 10 bp, Artificial Sequence
  synthetic observed sequence
acacaacgcc

What is claimed is:

1. A method for processing errors in data corresponding to a sequence of an oriented linear heteropolymer comprising monomers, the method comprising:

acquiring an output of data from an apparatus operative to identify a sequence within the linear heteropolymer to obtain one or more preliminary codes, wherein a preliminary code includes a plurality of base calls, a base call being selected from a group of one of at least three possible bases and a no-call, and wherein a preliminary code is intended to resemble a member of an expected known delimited code set of block codes, and wherein at least one of the one or more preliminary codes includes at least one no-call; and for each of the preliminary codes:
applying the base calls of the preliminary code as a vector of symbols of the delimited code set; and
invoking, using a computer processing system, an error detection or correction algorithm for a block error identification on the vector to identify one or more errors in the symbols; and outputting at least one error to a storage subsystem for utilization.

2. The method according to claim 1 further including:
analyzing the preliminary codes against the expected known delimited code set, for each position of the preliminary codes associated with positions of the sequence, to obtain a candidate code set; and
assembling the candidate code set into a table of candidate codes in a storage element for said applying step.

3. The method according to claim 1 further including designating as no-calls those preliminary corrected code sequences having at least one error.

4. The method according to claim 1, wherein the block codes of the known delimited code set have a minimum distance of D+1, the method further comprising:
identifying D no-calls on a preliminary code as locations of an error; and
correcting the D no-calls using the error detection or correction algorithm.

5. The method according to claim 1, wherein a base call includes a quality score, and wherein a no-call corresponds to a base having a quality score less than a preselected confidence threshold.

6. The method according to claim 1 further including the step of generating a code set for encoding the symbols, wherein each random pair from the code set is guaranteed to have a minimum ratio R of distance D to length L of greater than 20 percent from every other member of the set.

7. The method according to claim 6 wherein the distance D is greater than or equal to 3 for length L equal to 10.

8. The method according to claim 6 wherein the distance D is greater than or equal to 3 for length L equal to 7.

9. The method according to claim 1 further including
correcting each correctable error in the preliminary codes to match with the delimited set to obtain a corrected sequence.

10. The method according to claim 9 wherein said error detection or correction algorithm is a Reed-Solomon algorithm.

11. The method according to claim 9 further including the step of generating a code set for encoding the symbols, wherein each random pair from the code set is guaranteed to have a minimum ratio R of distance D to length L of greater than 20 percent from every other member of the set.

12. The method according to claim 11 wherein the distance D is greater than or equal to 3 for length L equal to 10.

13. The method according to claim 11 wherein the distance D is greater than or equal to 3 for length L equal to 7.

14. The method according to claim 1 wherein said error detection or correction algorithm is a Reed-Solomon algorithm.

15. The method according to claim 14 wherein the block of the delimited set is an artificial DNA sequence comprising an oligonucleotide.

16. The method according to claim 14 wherein each block of the delimited set of monomer subunits includes a tag, wherein the tag is used in a Long Fragment Read technique.

17. The method according to claim 14 wherein each block of the delimited set includes a tag, further including the step of using the tag in multiplexing a plurality of individual samples.

18. The method according to claim 14 wherein each block of the delimited set includes a tag, further including the step of using the tag in multiplexing a plurality of tissues of a sample.

19. The method according to claim 14 wherein each block of the delimited set includes a tag, further including the step of using the tag in multiplexing multiple libraries of a sample.

20. The method according to claim 14 wherein the block comprises tags and wherein elements containing said tags are randomly placed on one of a patterned and unpatterned substrate.

21. The method according to claim 14 wherein the block of the delimited set is a sequence of nucleotides.

22. The method according to claim 14 wherein the sequence of bases of the nucleic acid construct is a sequence of amino acids.

23. The method according to claim 14 wherein the block of the delimited set is a sequence of amino acids.

24. The method according to claim 23 wherein the amino acids are artificial.

25. The method according to claim 23 wherein the amino acids are artificial.

26. A method for processing errors in data corresponding to a sequence of bases for each of a plurality of nucleic acid constructs, the method comprising:
acquiring a set of data representative of the nucleic acid constructs from molecular attachment sites, the set of data including labels associated with positions of the molecular attachment sites;
analyzing, using a computer processing system, the labels to obtain preliminary base calls for the sequences of the nucleic acid constructs, wherein the nucleic acid constructs comprise tags, and wherein nucleic acid constructs containing said tags are randomly placed on a substrate at the molecular attachment sites;
assembling the preliminary base calls into one or more preliminary base call sequences corresponding to a delimited set of codes for the tags;
applying the preliminary base calls of each of the preliminary base call sequences as coefficients of a polynomial;
invoking a Reed-Solomon algorithm, using a computer processing system, for detection of errors on the respective polynomials to identify one or more errors in the respective polynomials; and
outputting said identified errors to a storage device.

27. The method according to claim 26 wherein the sequence of bases of the nucleic acid construct is an artificial DNA sequence comprising an oligonucleotide.

28. The method according to claim 26 wherein each sequence of bases of the plurality of nucleic acid constructs includes a tag, wherein the tag is used in Long Fragment Read techniques.

29. The method according to claim 26 wherein each sequence of bases of the plurality of nucleic acid constructs includes a tag, further including the step of using the tag in multiplexing a plurality of individual samples.

30. The method according to claim 26 wherein each sequence of bases of the plurality of nucleic acid constructs includes a tag, further including the step of using the tag in multiplexing a plurality of tissues of a sample.

31. The method according to claim 26 wherein each sequence of bases of the plurality of nucleic acid constructs includes a tag, further including the step of using the tag in multiplexing multiple libraries of a sample.

32. The method according to claim 26 wherein the sequence of bases of the nucleic acid construct is a sequence of nucleotides.

33. The method according to claim 26 further including designating as no-calls those preliminary corrected code sequences having at least one error.

34. The method according to claim 26 wherein said outputting includes no-call sequences and no-calls within a sequence.

35. The method according to claim 26 further including correcting each single error in the preliminary base call sequences to obtain corrected base call sequences; and outputting the corrected base call sequences to a storage device.

36. The method according to claim 26, wherein the molecular attachment sites are ordered.

37. The method according to claim 26 further including the step of generating a correction code set wherein each random pair from the code set is guaranteed to have a minimum ratio R of distance D to length L of greater than 20 percent from every other member of the set.

38. The method according to claim 37 wherein the distance D is greater than or equal to 3 for length L equal to 10.

39. The method according to claim 37 wherein the distance D is greater than or equal to 3 for length L equal to 7.

40. An apparatus for processing errors in data corresponding to a monomer subunit sequence of an oriented linear heteropolymer including a nucleic acid, the apparatus comprising:

a subsystem apparatus, coupled to an apparatus operative to identify the monomer subunit sequence, for obtaining one or more preliminary codes corresponding to the monomer subunit sequence, the preliminary codes being candidates of a delimited set of codes;

a storage subsystem for assembling the candidates into a table;

an error processing subsystem for invoking, using a computer processing system, error correction or detection on the candidates to at least identify errors or for correcting each correctable error in a block of the delimited set; and an output subsystem for receiving output of said error processing system.

41. The apparatus according to claim 40 wherein said error correcting code is a Reed-Solomon code.

42. The apparatus according to claim 40 wherein the block of the delimited set is a sequence of nucleotides.

43. The apparatus according to claim 40 wherein the block of the delimited set is an artificial DNA sequence comprising an oligonucleotide.

44. The apparatus according to claim 40 wherein the block of the delimited set is a sequence of amino acids.

45. The apparatus according to claim 44 wherein the amino acids are artificial.

46. The apparatus according to claim 40, wherein the subsystem apparatus is coupled to an apparatus operative to identify a plurality of monomer subunit sequences, for obtaining one or more preliminary codes corresponding to each of the monomer subunit sequences, wherein the preliminary codes correspond to artificial sequences, and wherein the error processing subsystem is further configured for:

quantifying the identified errors; and using the quantified errors to improve identification of monomer subunit sequences of natural sequences.

47. The apparatus according to claim 46, wherein the error processing subsystem is further configured for correcting preliminary calls of a natural sequence.

48. An apparatus for correcting errors in data identifying a sequence of bases for each of a plurality of nucleic acid constructs, the apparatus comprising:

an acquisition system for acquiring a series of representations for a set of the nucleic acid constructs from molecular attachment sites;

a first data processing unit for:
analyzing, from the series of representations, labels associated with positions of the genome attachment sites to obtain preliminary base call sequences of a delimited set of codes; and
assembling the preliminary base call sequences into a table of preliminary base call sequences; and a second data processing unit for:
applying the preliminary base call sequences as coefficients in the form of a Reed-Solomon code,
invoking Reed-Solomon error correction to at least identify errors, and
correcting each single error in a block of preliminary base calls in a preliminary base call sequence to obtain a corrected base call sequence; and a data utilization system for receiving the corrected base call sequence.

49. The apparatus according to claim 48 wherein the second data processing subsystem comprises a mechanism for comparing said preliminary base call sequences against an expected set of base call sequences.

50. The apparatus according to claim 48 wherein the acquisition subsystem is an image acquisition system and wherein said representations are images.

51. The apparatus according to claim 48, wherein each preliminary base call sequence includes a tag, and wherein the second data processing unit is further configured for:
using the tags in multiplexing a plurality of samples from which non-tag parts of the plurality of nucleic acid constructs were obtained.

52. A composition comprising:
a plurality of isolated oriented linear heteropolymers, each heteropolymer comprising a preselected block of a monomer subunit sequence, the monomer subunit sequence having a coding corresponding to at least one Reed-Solomon code of a length corresponding to five to ten monomer subunits, for use in processing errors in sequencing an isolated oriented linear heteropolymer.

53. The composition according to claim 52 wherein each randomly selected pair of said heteropolymers of the set has a minimum ratio R of distance D to length L of 20 percent.

54. The composition according to claim 52 wherein the heteropolymer is a polypeptide.

55. The composition according to claim 52 wherein the heteropolymer is a polynucleotide.

56. The composition according to claim 52 wherein less than five percent of the heteropolymers comprise a preselected block of monomer subunit sequence.

57. The composition according to claim 52 wherein said heteropolymers are DNA nanoballs.

58. The composition according to claim 52 further including a substrate for attachment of a plurality of said heteropolymers.

59. The composition according to claim 58 wherein said heteropolymers are attached to said substrate at spaced apart interrogation sites.

60. The composition according to claim 52, wherein each random pair of the Reed-Solomon codes is guaranteed to have a minimum ratio R of distance D to length L of greater than 20 percent.

61. The composition according to claim 60, wherein the distance D greater than or equal to 3 for length L equal to 10.

62. The composition according to claim 60, wherein the distance D greater than or equal to 3 for length L equal to 7.

* * * * *